United States Patent 7,625,699 (GENETIC POLYMORPHISMS ASSOCIATED WITH CORONARY STENOSIS, METHODS OF DETECTION AND USES THEREOF) - sequence listing, part 10

SEQ ID NO: 12437 - DNA, 12306 bp, Homo sapiens
gatgtgagattacatggccctgactgtcttgcctggtgctgcaggccaccttcacagccttgccataccttttcccatttatccatggattggtatgagccctaatggtgcacccttccgacaatccttcatccttcccagacgtttcatcagccaagtgaaatttgcaattgtttcagtgattgaaattatgcttggagtgcaggtgtcatggatgaaacagcaatgccttgcggtgacaaattcagtgtagaaataattttagcaagcccagtgattggaaaacaatgactcaactttaagctatattgattttgtatttctgggctcagcttttgactcagtctcattccccagaaataatccctgttaacatttcggtttgtgttatggaagtgttttctcttctatgaattagctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaaatgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtgggttgtttccacattttggctattgtgcataatgcttccaggtacacttgtctacacatttttgtgtggatataggttttccttttttggggtatgctcctaagagtgcaatttctggatcacggggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattctgcagaaaaaagtactgattgtccagcagttgtgtcaggtagaaaactgggatgcccgactgcattggtttagccagaactgtggccatgaaaccttgcctggcccccagggatggggtgaggggggatatcatatatgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcttggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgcatcaccaggcccagctaatttttatatttttactcgagacgtagtttcaccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcggcctacgcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcaatgttagtgacttagaaccacacaaaagttacactttacagttttggaggtcagtggtccaaaataggtctcagtgggctaaaatcgatgtgtcagcaggacaccatttctttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctgcttctgcttttaaggaaccttgtaacttcagggagtctaccctgataatctgcgataatctgcctatttgaaggtcagccaattagcaatcttaatgccatctacaaccttaattaccatttgctatgtaacatatttatagatatcagggattagttcatgaacatcttggggtagagggcattccacatacagcagtacctataatgtatatgcttcttaaagaatgcatgagtcttatttattttatgtccttggagtgtatagcagagttagatagatctttctggattggcggttgattgaatattggctgtacaaagaaactggttaggagtatagagaaaagatcaatcatagcactagcttatagtttattttattctttaatgattttttaaaaatatttctctcacttacttgaaaagcagtcttagaaattaactggaatgggtaatttatttgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattgggattaagggaaaatcaagtaaatcgagaggtaaagcactgtgcagaaatattggccagaagctatgaacagttgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaactgaacatctgtctaattgttcacctccatcgctttagtgctttcctcatgctttctctctttccagacaataaactttattttcttcataagaattcagtctacgcaagggtattaggcagcttgtttgcaccttttaattgctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccctccacccctgccagaaataaagggattaatctctttttgcttggcatagggagaagacagtgtctgctgatgtgcttaactttttttttttttttttttttggtcaggtgcgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttaggaatatccagcaagccacttttaaaggctttttatcacattttattcttaagctttctgaattccttattatattttgcctgataaatagttggattttgttttttggttcaatgtaagaatattcttaaactaggtaaactgttttaattgtttgtcattatgttctctcattctgttaaattttgttttctatttttcatgtttttgggtttttctagatggcctgtctttaacacttcttgatatttttgattaaattttcatatatcatcaaaaatagagatgacagccaggggtggtggtgcatgcctataatcccaacacttttggaggccaaggtgaggagaccacctgaggtcaggaattcaagactactgggcaacatggtgaagctctgtctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctgggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgtctgtatataaaaaaaagtatgtatacatatacgtatatgtatgtgtatagataaaaatgcatgtatggtgctgggcgcagtggctcacgcctgtaatcccagcactttgggaggctgaggcgggcgaatcacgaggtcaggagatcgagaccatcctggctaacacggtgaaaccgtgtctctactaaaagtacaaaaaattagcctggcgtggtggcgggcacctgtagtcccagctactcgggaggctgagaccgaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaataactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggatagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtggcatgagcctgtaatcccagcgactcgggaggctgaagcaggagaatttctggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcagtactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgacagtactccttatgaagggagtcatatgagttgctagctgggttctctggatggtggtgtcatgccaacatgggagccactagcacaaagaacatgctaggttctgttgagacctgactttgggaatagcataggtacttatctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccggtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgttattgtaaaagcatcatgcaccaggtaaaatgtttaataacacagagaaatctaattgtcaagtatcttctcaacacacattaatcaacaattctcatatcgaaggataacctcttgtatttacaaaaaaaagaagaaaaagtgctgtcatcagtaaattcattcatgtatgttatacacttacatacaaaatgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattatctgggtgtggtggcacatgcctgtaatcccagctactcaggaagctgaggactgagaatcgcttgaacctgggaagtggagtatgcagtgagccgagatagttctactgcactccagcctgagcaacagagcaagactccgtgtcaaaaaataaataatatatgtgtgtgtgtgtgtatgtacatgaattatatacaaatgagggaaaatatacaaatgagttgaatatatacaaatgagggaaaaattgttccttgtgtcaggaacaattactgtgaattttgtgtagcttttcctgactttttaaaattcaaatatatttcataaagttgaaatcacactgtggtctttttttttttttttttttttttaaccaaacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctggggctaaataagaagtttaaatgcaaatagataattcttgagaaagcttcttccctgtatatactctttctgcagcagtgtctgagtgtctgtaccttcctataccttcaccatatcatgtatttgtcattttatagtgagttgtattacttgctaggtgagctggtatctcctttgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtgcatgagaagccctgatgttgagaagctcataattcggtgtgagaaacacacaaggcatgatgccattcccatctgggatgaacagggaagacttcctgggagaggtgactatggacttaattttgctttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactgttcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcaccagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaaaaaaaaaaaagttgcagaaatagcaatatttaactatacttgttactcaaatttcaccactaaagcagtgtcatctttttattccaggatctagtccaggatgccacattatatttaattgttgtatctccttggtgcctttagtacttttttttttgagacacggtctcactctgtcacccaggctggagcacagtggtacaatcatgggttactgcaacctccacctcctaggctcaagcgatcctcccacctcagtctcctgagtacctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacagacatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtatctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagccccgttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcttgtcgcccaggctggagtgtaatggtgcgatatcggctccctgcaacctctgcctcccgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaaagtgctgggattacaggtgtgagctacagcgcctggcccctccc

SEQ ID NO: 12438 - DNA, 14557 bp, Homo sapiens
tatgttttaaaaaaaagaaagaaagaaagaaagaaactaaagcctagccccagcctttcagagttgattaatccccactaatgatttaccgatttgcagagagcgtgttctgcataaccggattgtgggcattaacaccagctcaaaggctgacattctgctaaaaatgaaagtaaatttcaagagcaattgaccacccctaatttgaatattctactgacactctgggaggacccctacccacacccacagcctaggggctgaggcaggaaaacaaaaatacaaggaaagattcttcccaaagagatatttcaccttctgtccctccttcccttcaccaagacctgagattaaataagttagatcgctcctttctcttctgccaaaggcagcgacggccctactactactcctctcttctgccttgggctctaaagattacaggaaggacagaagaactggacacctgaaggggctgagcttagagggagagacgtaggggctttgagggctcagaagggtgagctcatcctatgcggggagagctttaggatggtggcaagcactacaaatctgtctagatggcacccaccctcgccaaggcagtggatcaataagatgaccctggcaccctcctaagactgggaatttatgacagctaggaccctgccagactcttccagtcaaaaccacattgcagctcagaatgcgcgggcagcaagccccagtgggcgtggtccctcctgacactctttagcaagaactggttaggggagcaggcaggttccacgcctgctcacacagcctcttacccaccccagatggccggccagggagggaaatcaagccacactttccctttccaagttttcttcaagcagtgatctcacccccatcttctcaagcagccaacagagaccatattgcccaactttcagatgaggatacagagggttaggaggctgacactggcccaaaatgaggcctgagtcagggccaagatggaacccaggaccctttactgccaagccaggccactctgaaaaggcaagatccagggcataaggagactgccaggagggaaaggaagtggcccgcgagtgctgccccggtccagccagcctcaaagactcaaagtccatgcatgcgggaggcatcctaagatacacagcctgtccggcagcacttcccatgggccccatctctcctcttcatctcttagcattcctgacttgtgaggaatccaggtggagcatcctggagcctgtcttcccccagcactgaaaaggcctgaggtctgaaactgcatctgctctcaacccatcctggactcctaaccaactgaccaactcacagaagagagctcgggggctcagagaccaaagggggaaagcagccagacccagctgcctccaggagacgctgagcaaggctcttcctctttctccttcccaaagctgtgctcggcgtgccattgttaggccccctgacacctgggatgtgtgtctggaatactgccctgtgtatgtggccgccagggtgctgatgacgactgactcgtgagtatagttgtattctaggtcccacgtctgtaacccggggctttgcagaaagagtataaggagctggagcttgtgtagcctgtccatccctgcagagcctccctcctactcccagccccccacagcccccggctcagagaccccccacagcgagggccccatctgctggaggctcggtgacctgtgtcaaatgagtaggcgctcggtcacactccagagcctggaggaggctgctgtgctctgggaaagcccaagcagctcctgcctgggggcgggctgggcagaggccccactggggagggaggcccgggagactctgaaactggcggcggcctggctgggagctgcactccacagaaaaggagagtgggaaaaaatatgaaaagaaaagccttgggcctagcgctgcaaccaaaccatgtggaccaaactctgggttggacacagccctttcctctgctttctgatcccctgagcggatctgttatttcttacagggtgtgggtagatatgtctgtgtgtctctgtgatgtgtggggtaagcctctttgtgcatctgggtgagagggtgtgcatggctggctccacgtgctcttgtgtgtgagtatgatggtatgcctatgtgtgtgactcggcacaccagctgagagtctccatgtttgtggccccaagagcctgttaggtttcatgtatctctgtgtcagcaaagcagtgcctacttcagcctatttcagcctatgtgtgggttctgtgtatctccccatttagacacatgcctgtatttaccactgggtgttgctttgtgtgactatcaatattcagcctaatggtgcaagtttgtgtgttcctattgtgaatccgtacattcagtcctgtgctaaattgcatggttgtatctgtgtgtgtgtgtgtgtgtgtgtgtgtgcacacctgttctcatgcccacaccactctgtgtctgcatgggtcacgtggatgtctgacctctgtgtgtacaccctgcctacgtgttgtgggtctgaggatgagttctccccagggcctaagaaggtggtgctgcaggacaaaggggttgctcagctgcagatgtttctaccagtggccatgtctcagccctagtgtcccacacagaatcttaagagtgatgtcaagacttcctgggggaaacttaactcaaacacaagaaaattctgactcaagaccaaacccatatccctgtagaaggtctaaaatttccaaagcagagaaaagaattatatctttcctgcttcaaactgctttccagcccaggccagcatctaacatttaaagggcacctaaattgcatgccttatttcatctgtggagcctcagagcaatcctgaaaagcaggcattattgttctcactgtaagatgcacaaacttaggctccaagaggcaatgtggctcacacaaagtcacagggctgctaaaggacatggtgggattgggactttgatttgctgggtgacaagctgataacctagaagcctcgctactgctctactgctgatgcccctcaattcagcacagacatgggaagacggtttcaggagccccagcaggccctggcctgcccttgagacctaccagaaacagggccaagggctctctttgctgtgccagccaaagctgctgcctccatagacccccatcccacggtaatgaggggaatgatgagtgaaaactcacaggtcctgtgcccttggacaaattttgggtccctcatctaggcaatgaagataataatctcagtgctctctcacagggctgagaggtacaggtaaaagtacttgctaaaacactgtgcctgtatgtatacctatgtaacaaacctgcacattctgttcatgtatcccagaacttaaagtataatttaaaaaaaaaaaaaaaatccgtgcctgttggtcattgttcttccagcctcagtggcaattccaaaggctggaaatcaaaacacctgcccgctgtccagacttccttcaacaggaactgagacagattcacagaatcacagaccatgagagtgagaagtgccagagaggtcgactggtccaaacctctgcaatcccacgctacaggtggagaaactgagatttagttagagagggggaatgccttgcctgtcactgaacagcaacaatggaaacgaccaaagtaaacacctatctgagagctttacacccccgttgtctcacataactatctgacctaccttagtgagacaggtgggctgcctatagtactgttattcccaacatacaggaaggaaaaccaagagctaggaaggctagaccagagttactcttgcccagggagatgatggcagctccaggttgaaagcccaagcttcaatatcacacaggcctggttagggctggcacgagcatggacttcactgcggaattcccagtcttcctcctacctcccaggcctgggaaaggtgaaagacctgggctgcctcaaggtgaccattccctgggccagagtccaggaaagcccagtatctctagctcggttcagacacagagctccatcgcagctcttacagctagggtgggaccacggagcctgctcaggacagtggccaatggcaggataagggccctgctctgtcccactccttccctggctggtcctagggcattcagggcccacatgatcaaagtctgtgcccagggtgacccctgtcactgtcaactctgtcccagccgccctggatcgttccaatggcagctgccacctgagcccccagcaacttttttcaatctaaggatttattccacagacctgatttgcccagtggggccctaggtgggcccccagctcagttctgtgatctgggaccccagggccctgtaagctataaatccacttgaggctagatccaggagagaaaagagggaggactggcagctgaagactccctgggacccaagcctcggtgtggggaagaggagaaaacacagctcagtaccctcagcctggggcccaaggtcgggtaagaaggcacaaaggaactgcagtgaggtccgactccactcaagatccttcagggagtcctcaagggctggggcgtgaggaggtagctaaattccactgcccacctttccaacaaggcctcctcaatctcaattcccttttcagcagctccaggcaagtccgggcaaactctagcccagggctcttagcgaggctggacagctcccggcctgcacgccggatttctggagagcccgagccccttccctgagcccatccttctcctctcccggggcgtgatcccaccacgaccacagccgatgagccgttcaagctgggagaaggagcgagaaggctgcagcggcgcaggtcagatacccctgggcccaacgtccacccccaactagcgcccttgccagcagcgttttccccggagccacagtctccacctcgagatcttctccttctggaaccccggagcgcggccgggtaccaggggctcgcgtaggactgtagaaccgctgccgcccgccgtcccagccccagctgcccgcgcggtactcacctgggcctcagtgcccgggagaaggtgtgcccgcgcgaggcgtgaagccagagtccgtccgactccgcccgcaccggacgcgctctcagggcagaggaggtcggcggagttgtgacgctgggactagaggaaggagaaggaaagccgagacgggccgggcagacgcgccgaggagcgcccagtgcacgctggcagccgcgggaggcgaggcgggcgcggtgagcagtcgcgccggaaccgagccgcgaatccgcgccgcctcgcgctcgcagccgccaggacccgcgggaatcctggtccgccggcagcggtactgaggagggaggggcgcggggctgagccgcttctcggagcccgagcgcctcccggagccggcaatccctgctgcccgggcgggatgcgggcgggaattcagctcgcgtggaatgtgggaccggccgggctcggagtctccagcgctgggggaaagcggggcccacacagccaggacgagagggggtgcggtcccagggccacccccgcgccactccccacgtggcggccgcgcccccggggcgtgagtgtgtacgcggacggtaggggggccgtgaatgaagccccagcggccaatcagcacggccggcgcgcgggaccccgggagcgacgcccaatggagagctctgggcggccgggcagggtggcgggcgggcgcgcggggcgggggccgggcaggggaggcgggaggcagctccgcgggcagccaatgggcggcgggcggggtggggctccggagcgccgagcgggtcggggctttaagccggcggagcgaggcggcggggcccgcagacggagcggagcggcggcggcggcgcggcgcagggcgcggggcggcatggccaccaccgcgcagtacctgccgcggggccccggtggcggagccgggggcaccgggccgcttatgcacccggacgccgcggcggcggcggcggcggcggcggccgcggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcggcccgcacctagaacacggcaaggcaggcggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaactaacaaaaaaaattcgagtgttcatttttcgtttcgtttcatccgagccccggcttggttcccggccacgccggaggggtctgcgctcccacacacccagacgggaaggggcytctgccctgctgcagaccgaccgccgcatagcgcggcccctgctccccgcggggccctgccctcctggccacaccaaacgaaacttggaaaagttagagagattgttttttaaccagctgtagaaataagccgttccctgagaaccctccgcctgattccctgcagcttccctctgctccctttccagcccgccgggatgcgggatgccaggggaggccgggagagaaattccccaagtttggggtgaggtgggaaccatgtaaatatgtgagatatgtacacactggcggggagaagaaacattttgtgcttggtttttatttttggttttccgggttacccttccttcctaccctaaaggattttgtacactgactaatccgaaaaagatattttaatatgatttccgaatttctgacccatctctatttattttctggatgtgtttggagcttcccccttctccgtttcttcttctgtttgttaaggtttgaatttaaattttgttattttatttttattattttttgaaacaatgtttcggtgcattctctttgtatctttattgaaaaaaaaataatgtagactgggaagttccctttatatttatgttatagtaaatattttattactcacataaacatgtaccccagggctgtgtcctgtcctttttactgctagggctgggtgggtttttggggtgaagcgatgggatcccctgcttcacctccctgaagttctgatctcaccaggagagatcttggaggaagatgaccctgcagaccttccaggtggatatcaggacatgggcaacagttgggcccctgcctcagatgcatcagtttagggaagatgaagctgcctcgtgtccccctgtcgtagacagactctcctagaccaaaccagggcccgggacagtgagccaaagacaccacatggaattcggatcagccattgttcatgcacaactcgactgctcttctccaccaagaaagaagcccacctcggcctgggtcaccagcctagaatctataatcccccacctgacacctcaacccccaactttcatttcaccttgcactctatatgagaggtctgagccaactttaccattcccagtcctagggcacctggaagcctggtgaggccccaccatcctactccagcaggctctccacccaaactcaaatggtgcccaagcccccctggatgcactgggagttctaacagcttagacagacgtggctttcatggtcctacgtgagctgggtcagcctagggagggagccctgccaatttgcttgggcaaagccggtcttatgtctctgcaaacaaaccgctgccccagcttctgttggggagaagtggaggcacgggtaactgtgccatcagaaagacctgatatcttctttccaaggttgggtacccaagaccctcatcaccgccaccactgcagggagtgataggaaggagagcacagacctcagatgctgtcttctggagtgagtcagggtatctgggggcagatctggttcccgacgcagagctccagactacctgggttccagtcaagaccttattttctcctttaaaacaacccttcttaaaaatactgataaaagagctcttcctgcttcctccgtagacgcagttcttttcccctctcaggagaagccacatgcggtttctctcactctttgtgaagccaaagcttgaaggcacaatctcttagctggggagaaagctgaccctagtgagggggcgtgtggggcccctcctgccagggaagcggcccaagtccaggcctgtgagaggcctgggctctagctgacggtgtcagggatgtccagagaggtgtccccagggccccaagttggtgctccccggcggggctagggcctcgggatgactgtgccatgctgagagttcctggcgactttctgcgctcggccctcactcttggggggaattgtctctgcaagtacaaaggctgcctcggcttctagaggcccagcccctcactccctgctccttttttcttctcctcctcagctcagtccagccaggtgagtgaatagccctgtaattggcacctgtgtcccagccgttccccacactggtgggccaggcagccttccctcccatgtttcctaaagaggaagctggcaacataccggccagctgggcaatggcatagccaggagccactgaccaccctgcctcagcctctcatttcctactccaccaagaacaaaactttgaagccgccacacactcctccctgctccctcatttctccattcctggatttgtcccagcctcaaggctctgaaatggaagcaaatgaagctgagagctcccgccgcctgcgcggcccagagcctcagcaggttttgaggttggaaagggccaccgggaagatgaggcctttcaccggcctctgcctgcagctgacaccaattgattgattgatttcctaattgtctgcttaatcctctacaagagggtgggtttattatttaagcaagtcaactcaaaaatagcaaaacaaagcagcctcccaagaaccagcagcagctgaggagtagaacaaaaaaaaatgagaaaaaaaaaaagtggaaaaagggatggaagaaaatcttttactttgcaaggatttggcttaatgagataccagcatgagatagctacctggtgatcaaccccttggtcgcagaaggcccctacatggtaggaatctcagcactttataggaaagagaaatctttttccctggatagaatagagttaggacaagcacagccaactgtgggcttgatgcagtctctccgtcccaagggtatgtatatctacctgcttgtgcctgagagcctcagacttccttttgttcaggagaggtatgtgtccctagcatcaacctccaaggaagtccaagctttccctagcatattgggaattttctgatcccatctccttccgcatctcacttgaacaaaattattgtttatgttgatgtggccacagattatggtagttagaactctctccccatgtgaacctctgcaagttggtgtaagaatttgtgtgtatgctgttgtgtgtgcaaagccacagccaatcccagaggtaggagagggaaaagaaaacccaggctacactgctaatgctttcagcaggaagaatatttgtagaatggaggttggccaataccaaaaggaaggaaaatggtcatcttagtcacctgcggtcatcaaggcaaacccagaaggtatcctgccttgaggcgtgacgacattatattctcccccacctactgcccagaaggttgcactaatttatatgttgcatgccttaggtcctatgcaatcatcccttgaccttaggacttgactggatgtccataggactaactgacccccaatcgcaggtgcccacttagagccgtttagaactcatcctcccctggagaggctctgggcctccaatgacacatccagggccgggctgcctccctccctggaactttccctagcagggcttcagctccaaaaaggagacccacctaagcagagggtggagtgagaggagactggttatcaggcctagttactctcctaagctcagccaagatgatctacccagggcctctggctcagagactgagaccagaggtagctggaggagccatccgttttgtccctgcctgtcacatttgaaggctctggagttgaaatggtgtttggccatttagggctccccttgctgcctcttgaggcctccatgtgggaggactgccctctattggtccctgaactgggacctggtagcagttaccagagccaccttgaacctaagcatgcccttaaaaagtcagcttcaagtgggctgttcgaggaggactgccagttagagcagaggcaactttagcctccaaaagaagcaagcctgcctctctctctctctctctctctctctctctctctcacacacacacacacacacacacatacatacacacacacactaatccatgacccttccctctcatcttccaccctgcccattcacacagccactctcagaaacccacgatcatacaccacctcctctctctctctctccactcatccccatccccatcactcctcccctcaaccagttaaaaccccaatccaggctctcaccaccttgctcactcacacgcatgctaagacacccatggtcacacccacaccacagtttgggcagtctaagactagctttctggtctttggcactaagctcttgagagtcactgagtacctggcacatgtaatatttgattaagcacacacggccatcctttgcaacatttgacctggtccccttctctcaggatttccaagcacttgcccctaaactgctttccaaacacattcctgtccatcattgtcccagctcctcccagatctcttccggctcctttcagataattaaagttaggctgtgtgtttgtatgtatgtgtgatcttattttttaaacacacacccccacacatacatatgcgtgtatatatacaaacacacacagcaattagatctatccattcctgccgtagtccttcttgtgcagtaaaacctcagctatgcatatgcccccacattgctatgcaatgaacccagcatcacctagtcacgggcccctgatgtcacacacacacacacacgcgcgtgcgcacgcgcgcacgcacagtggcacgttcacatggttacattggtctttctccaagggcatgacccacctcccactacccaccccgctcctgggcatctgagtgggctctcctcagatgacctgagtaccaggagagctttgctccaatccctgcccccaacacatacacaccagtggacatgtctcctgctgagcctgaccagggtgggtctgggtattattaggctgcagagacagcacggaggcatatggtctcgtacacaagaaataatgttcatgttaaatcagacctcatgcataatgcatggtgcctgatctcacattattttgggtgttcgtcaaaatcagtgttctttcttataagggctcctgaaaagaagtgaaaaggcatttgctaattacacccacagcctggacccagagagctgggagtgcccccgggagcctccctctggccccacttcacccacagtgggtcccatccctctgccccactctgtcttcccacttggaaggaggggctgcctggggtttgtggcaggcgtaaggccccgtgttatttttatttcttttctctcggctctctgtccctggagggttctggggaatagcagtggctctgtcgctctcacacccgattcatttgccgttttatgaactccccgttgattcatcgcctccctaagtcaatgattcactcctgatggcttttcagaaatccttcttcaaaggctccagattattcagctctgagcaagagcaagagccggagcagacctggaccctgcattaccactgctccgtggcctggaatgggatattgtccccatccttgggccttccctggagctgggctggcctggagaggagggagtgctccatccacacagaagctggtagagctgacccaagcagctcatggacagaccaagcccatggccaggcaccctccagcctctgtgggtcacctgccttctccccttgtcatcacagtccctccggaagctatccacgcctccgaggaggtagagagcagaatggtgaaagacaggggctctgggaccagacacctgggcaaaaatcctgtctccacttcttatcagttttgtgactttaggccaactacctacatttctgtgcccccatttcctggtatggtaacaaaggcagttccctgatcatagagttgttttgagaattaagtgggataatatgcatatagagtttacataagtgatgaataaatgaaagctggttttttgttgttgttggtttttttttttttttttggagacaaagtctccctctgtggcccaggttggagtgcagtggcgcaatcttggctcactgcaacctccacctcccgggttcacgccattctcctgcctcagcatccctagcagctgggattataggtgcccgccaccacacccagctaatttttgtatttttttagtagagacggggaggtttcactatgctggccaggctggtcgcaaactcctgacctcagatgatccacccacctcagcctcccaaagtgctgggattacaggtgtgagccaccatgcccagcctgaaa

SEQ ID NO: 12439 - DNA, 12731 bp, Homo sapiens
gatggccaggctggtctcaaactcctgacctcaagggatccacctgtgtcagcctcccaaagtgctaggattacaggcgtgagccaccgcacccggcccccattgatttatttattaatatagatacaggcttttatatattggtttgtgatttaatactatttcattttatttatttactttttgagacagagtatcgctcttttgcccaggctggagtgaagtggcgcaatctcagctcactgcaatctccagcccctgggttcaggcaattctcctgcctcagcctcccaagtagctgggattacaggcatgtgccactgcactcagctaattttgtatttttagtagagatgtggtttggtttctccatattagccaggctgacctcgaactcctgacctcaagtgatccacccacctcaacctcccaaagtgctaggattacaggtgtgagccaccacacccagccaatactattttattttgttgctcaaattttttcacctctccaatgaccttttactataccctgtcggggtgcgtgtgtgcatttccttacgttctggcattacaagaaagtaaggaaatagctcctcttgtatatttcctgccccaatcctagaatcagtcatttcttcaaggactcttgaagaagttattagagaataactgttattggagaatggtattagaaaccgagatctgggccaggcacagtggctcacacttgcaatcccaacactttgggaggcctagatgggaggacagccagaggccaggagtttgagatcagcttggtcaacaaagggagaccctcatctctaataataataataataataataataatattaaactaagatctgcgtggtaagtatgctcattgctactggggtgtcttgctttttggaccttctcaactgtcagagtaagtgaatatatgtatatactacagtatacacacatatttataactttctctatgtaatcatctgtatatatgggtcagttttttttttttttgagatggggtctcgctctgttgcccaggctggagtgcagtggtgcaatctcggctcagtgccagctccgcctcccgggttcacgccattctcctgcctcagcctcccaagtagctgggactacaggtgcccaccaccacgcccggctaattttttgtgtttttagtagagacggggtttcaccgtgttagccaggacgatctcgatctcctgacctcgtgatccacctgcctcagcctccaaaagtgctgggattacaggtgtgagccaccgcgccaggccaggtcagtttttttttttttaagtctacctgttacagatatatattataatatttacagctgaaattatatggctaagatttgcttttagaaacttcagcaatccggctgggagtggtggctcatgcctgtaatcccagcactttgggaggctgaggcaggcagatcacgaggtcaggagatcgagaccatcctcgctaacacggtgaaaccccgtctctactaaaaatataaaaaattagacgggcgtggtggcgggcacctgtagtcccagctactcaggaggctgaggcaggagaatggtgtgaacccaggaggtggagcttgcagtgagccgagatagcgccactgcactccagcctgggtgacaaagcaagactctgtctcaaaaaaaaaaaaaacaaaaaaaaaacaaacaaactttagcaatctctggttgtctagcggttaggaataaaagttgaagaaaaaaaaaacccagcaaaacaacaaactaggacaatgaaatacaattgactaagatagtcattgaagcaggatgccaggtacactggggattcactcattatactgttctctctacttgcatgtatgtttgaaatattccgctgggcacagtgactcacgactctaatcccagtactttgggaggccgaggcaagtggatcacaagtcaggagctcaagaccagcctggccaatatggtgaaaccccatctttactaaaaatacaaaaattagctgggcatggtggcatgtgcctgtagtcccagctactcgggaggctgaggcagaagaatcgcttgaaccgggaggccgaggttgcaatgagctgagatagcaccactgcactccagcctgggtgacagagcaagactcagtcttaaaaaaaaaaaaaaaaaaagaaaaagaaatattccataatacaaaataatatgactgggtgcagtggctcatgcctgtaatcccaacactttgggaggccgaggtgggcagatcacaaggtcaggagttcgagaccagcctggccaacgtgatgaaaccctgtctctgctaaaaatacaaaaattagctgggcatggtggcatgagcctgtaatcctagctactcaggaggctgagtcaggagaatcgcttgagcctgggaggcagaggttgcagtgagctgagatcgtgccactgcactcgagcctggacaacagagcgagagtctgtctcaataaataaatatgtacatacatacatacacatataaaataagaaaatagagccagaaaaccctcactgaccaggctgcagttaaagagggtcaaatagagaaagacagccagccagatacaaggcattaacacacatgcacatacaggcacacacacaagcatacatacatacacgcacatgcatacacacacatatacatacagacgcacacacgcatacacacaggcacacacacatacacacacacatacacacgtgtccatacacacacaaaactcttccacagccatctttaggtgaaattttgaagatgaaagtttttcttccatgtttggacccatctgccctttcagaaaccgcaaccttattgctctactgcttcctaaatctgcttttggagggaaatctgatcatttgaaatatttcctgtgactgaaagtcaaagtgtggtcttcttaggaatttacatttctgtgtcatctttgatggggcaagaagttgcattgtttctggcttaggaatttcaggcagtgggtgtttgacagggacagcaacagtccccagcacatgtggaattacacatataggtaatgtttctaccagtcccagaggtttctctaaggtgaggaacatagtctgtggcctgccccatccccccatcccttgagtggaacttgcccactctcacctctttttttttttttttttttttttttgagacaagatctcgctctgtaacccaggctggagtgcagtggcaccatctcagctcactgcagcctccacctcccgggctcaagtgatcctcccacttcagtgtcccaagtagctgggactacaggcatgcgccaccacatctggctaatttttgtatttttggtagagacagggtttcaccgtgttggccaggccggtcttgaactcctgacctcaggtgatcttcccgcctcagcctcccaaagtgctgtgattataggtgggagccatcacgcctgggcaactcttatctcttgagacagtagttgggaaagaacaggtctttggttatatgaccagtgagactgtcatgatcctgcagctcaccatggtttcctcttgtttcccccactctaggggtggggcagaaggccttaactctgaaaaagctgaaacagctgcttcttcagagtgccggaagttggtagcagagtgccctgcttctgtggacaatggtttttatctccaggtttgtcttcatcttctctggatccttggcctccttgaacagttctgggtcataaaaggctgagagtgggcagagagttattttactagattagtgagatgctgtgcccaacctagtcccatccataatcaggggctgccgctggcccttcctctcactcagtcttcctccacccttgcggccccttcttactcctctggaatagagtatagctgcttctggttctgttctaaggacaggaactcctgggacagccactcccgcattaggtcaaaaacatttcctgtggattttattagtttccttccaaacaatgcatttatggaagaagaagagcttttgcaggcatgcatttgcacaggcagccaacctcctccagtcacacacagacacacacacacctccacacccacacgcacacactttcttcccatccgcccacaaagcatcagtcacatttagaatttgcacaaatgcacaccctccctcatacatcacaatgcacaccctctcatccacctacatgtctcttccacaaaatcacacctgctcacatacccttagaagcacattcctgtactgtgcccagagagagaaaggtgggggagataagcaaggagaatgggttagaagggctcaggaggtcaaacctctgtaggagctgaaaagtcagaagaccaggaccccccactcctctctgccctttttttttctttctttcttttttttttgagatggagtcatgctctgtcgcccaggctggagtgcaatggcgcaatctcggctcactgcaacctccgtctcccaggttcaagtggttctcctgcctcagcctcctcagtaagtagctgggattacaggcagccgccaccacatccagctaatttttgtatttttagtagagatgaggtttcaccatgttggccaggctggtatcgaactcctgacctcatgatccgcctgcctaggcctcccaaagtgctgggattacaggtgtgagtcacttgttcccggcctcctctttggccctgtaagtagaaatactacggctgggcaaggtggctcatgcctgtaatcccagcactttgggaggcgaaggttgcagtgagccgagatcacgccattgcactccagcctgggtgacaaagcgggactccgtctcaaaaaaaaaaaaaaaaaaaagaaatactatgaattgagagagatttagaattaggggtaggggaagcaggaactcagggccccctgtcccacacagaaagtgtgctgcctctgtgacagtgatgtatctcaggctggtggctgaggtgggaagtttgtcaaggctgtaagtggcatccatcacatgtccgagaagcccattttgaccagtagaaaaggatggcctttagggtgggattccctatcagctcaggaaatggtgcggagggaatgaagagagataaggaagtaaaaggctgggttgggctctgggtccaacatcctctagaatgaatcttactaatgtcagctggaatcaagaggaggaggctccccttcactggaaacttgaagtccccctcagagaaaaggcgggagagagggcttggaaaagtgacaagtgcccaagagcagcccaggcaattctgccttcggccccagactattgtctgcctgccctgactcagcccaaactcagaaactgtggattctggaaagtaacgagacttttcctttgggaaagggtcctgaagctgacccacagtgctcaagaaaattggcagagaggccaggcacagtggctcacacctgtaatcccagtattttgggatgccgaggtgggcggattacctaaggtcaggagtttgagaccagcctggccaacatggtgaaaccctgtctgtactaataatacaaaaatgagccgaacatggtggtgggcacctgtaatcccagctactcatgaggctgtggcaggagaatcgcttgaacccatgaggtggaggttgcagtcagccaagatcgcaccattgcactccagcctggacgacaagcgtgaaacttcatctaaaaaaaaaaaagaagaagaagaagaagaaagagaggaagaggaagaagcagagaagaataggaggaggaggaggggaaggggaagtggaaggggaaggggaagagagggagaggaagaagaagaagaagaagaaagaaggaagaagaaggaagaaggaagaagaacataattgccagagagctcagtgaaacagagacagaggagacggaagtgagccacacactctgtgtcctcgcctcaccaggaaactactaaagttcctggggaagcaaagtagaatttcataagaacaaaayggatggagaggagaaaacctatggtggctgtgaaggccctgatgccacgtatgtcaaattgatrtcatctgatggccatgaatttattgtaaaaagagaacatgcattaacatcaggcacgataaaagccatgttgagtggcccaggcgttttatgggtttggcttttaaatttaggtctttggtcttaagttaatttttgtttatgctgtgaggtcagtttgctgagaaygaaaccaatgaggtcaattttagagagataccttcacatgtgctatcgaaagtatgcatgtattttacctacaaggttcgctacactaacagctccatcgagattcctgaattcccaattgcacctgaaattgtactagaactgctgatggctgcgaacttcctagattgttaaataaaataaattataataaactgttaactcttttcagtatgtaatacctgtagatcagttagtaactttttcatatatagcatgttgcctgtatgcagtttaactatataaagttcattgcaaagcagattatcttgtttttttcatagcaatcaaagttgaaatttgtttgctacatcaacaaattaagaacattttcacaaactgagaaataaacaaatatgccaattaaaaaaaaaaaaagaaagaaacagagacagagatatctggcccctgccatccatgtcttgacagtgcctcatgagtctctcctcctgctgccgcctgggggcgcccccagctgggtctcaggctgctgccagcactgctgttgttatcattagggtaattaataaacaagcactgctggggccaagtggaagaagaggcaggcccctgctgctcaggagaatccctgaaaagatccagtgagcctgcggcaaccggagctgagtggctggtccctcctctctacccaggacctctggaaggggtgtggggtgggcttccccctggagggaagggcaaggggaggagcacacttggtaggcttggtttggaaccagctctgcatgtgcctaacaggatgtctgtgggcaaggccaccctcgtgattactggttgtggggcaggctctgaagcaattattcattcatttaacaggcatctgcctatttatttatggaaagcctactgtgtgcaaggtggtctactaataatagctaatgtttgactggacagtgtgacgacacagccaactttcacaccaggtcctgggaaaaggggtagaagcaggggaagcaaccaggaaaaatgacagcccaaaaagatacgggcaattaggctttggcctgtgtagtgtagtggtggggatatatattaggtaaaacctggggattaccaagatcttgggaaactcaggacccaagttggaaaacatacggcaattggggctggagaaaatgggcatttttcaggtgggagggacttggagataaaggcatggcaataggacatgaatatggggattttgggtgaatggctcaatgaaagggaggcacgaagggatgctagccgatcctgttgggggagccccgggtcacggcagtttcggggagccagatggatgggagtgtctaggggttgaggtgctctaagtcctgagagggggatgctggattctgggatcagagtccgaacaagagttggggtgtggtgggggctgacagcggggttttgagggaaggctctggagggctgggttagaaaagatgccggagcgggtttagggaaaggaggggcgtggccggggagcccatcctggaggccaagccggatcctcaggtttggccagggggcggctggggccggcgtgccggcggggcgccggcggggccgcgggggtttgcggcgctggctgggattcgcgctccgagccagtcgccggggctccgcgggggggcggtgcgagctcgggctgcgggcgggccgggaggaggcggcggctccgagaagaacatgaatcagcggcggcgacggcggcgacggcagtggaaggagcgcggtggcgcgggagcggccccggggaccccgcgctgctgacggcggcgaccgcggccggaggcgggcgcgggtctcggaggcggtcgcctcagcaccgccccacgggcggccccagcccctcccgcagccctcctccctcccgctcccttcccgccgcctcctccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtaggggctggcacgggaggcggcgggaagcggggggctgcggaggggcgcggccgggggtcggagcccggggcgggcctggcgggctggagtcggggtgggggtccggagccgaaggccgaggctcggagccgggacagggcacgctgcggagtgctcgccgccagatctccggccgggcccccacccccaactttctggcgctcggggctcttctggcggggtggaagagaagggagcggggtgtgggctgtgtggtcagcggggagtgtttgggactgcattttcccgcctcgatgttcccagctgttagctccctccttcccagtactggggaccccattctgcctgccccgcacgcgaaggtccgcctcggaaaccacacgggccggggctgggcacccaaaggccaccctgataccatttaggtacacaggggctgtgagggtgcccagtcacaaaaaacaaatgggcacactcgagttcctgtgccctcagagcttcctgaaagcagaaccttggagaggatgggctggtgccaggttgctggtctttgggaggggttagtcttgtgttcccacatagccactgaggcatttgctggtgacaagagcgttccatgcagcacggtgctctccaagttcccaccccgcacctcggggactgatgggcatatagggagcgggaggctggcccccatcctgtgactggtcctgagagggtgaagggagcagggaagagccacaggccaggacagcggccacccgctggcatcttctcttgagacagcattccttgccatatcagcctctcagggaagggaagggaaacggggtgacgagtatttacaagccgaaaggtgcggacctgatgctcagggagcccacgactttgcctagagtcacacagcaaagggtgagaagaagcagggctggatttcagttatgtggatacttgacctgcccctctctctgcttaaaaacatgccaggaggccaggagaggtgcgtgtatgtgtgtgtgtgtgtgtgtgtgtgtgtgtgtgtgtgcgcgcgcgcgcgcgcgctcgcacgcaagttccaaagagtggcccctgttaatgtggcagtggctcaggggtcttaggctccctgctcagggccccagccctcccttctgcctcccaccttcctagcactcgcccctgcccacattcaggtattaatagagtggatggctgccaggaaggctgccatgtgtttgatctgacgtggttttgcagccatatgttctccacttcaggggagcaccccctcctttccttcttcagccctgctccatttggtaaggttgggtgcagagggtgctggcagcaattcagggtctgggctgacaccttgggtggagagctggcagcctgttgcactagttgggtgcagcagtcattcctagagcagtgcctgccccagtagggtaactcccatcgtttcagcccagcctgccttccttttgctgtctgggctcagaaggaggacatggggaagaggtgcttagagccggagggaacttggagagcttgccatgccccttcccttcgcccaggtccagcgaccttcccttccacactgtcctacctctgcttccttgactttggctgagaaagagccctctgtctgacacagaagctaccttctagaagagaatgggaactgtttacagagacagagtccctctcaaggctgacacatgttccttcccacccctcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcaggtgcaggcctgtgggggaaggtgtgggctgccagccagggggcaggctatgctctttccttggggattgggagctggggccctctcctgatgcccagaggtctgtggtttttttatttggctacctgtgggaccttccagaagtgggggcaggctgaactcatcaagtttgcccagcagagctgccgcccttgccctcggaagcaagcctcgtatcctgtttccacagcctgaagtcagtggagcgctctgacgccggccggtactggtgccaggtggaggatgggggtgaaaccgagatctcccagccagtgtggctcacggtagaaggtgaggaggcagagccatatgggcgtgttggcctggagcacgtgctgtctgctggtgactatacctctgcagcggagaactcagtagaagctgggctgccccactgctctgtggggcctggttgtccaggctgtaggcccactccagatgtcggaagaccctaccagttggagttgggtatctgagaaccaagggaccaactgggatccacaacctgtggggtgcagtctgtttccgttgcttgagcaacaagcttcaagcatccatctgggactggaccctgttctgccaagtggcctggccagcagggggaggggaggaaggctctgcagctgcgggagctcagagctgttcagcccaggaaaacaaagtgactaagaaagtaacaaagggccctgaatgggagctggggcctggcagcagaactctgctaaagctcccacccactcccctgagttttatgcccctctcccagctctccacccccagtctcctctcttactgcaagaagagctgtccaaatctgccatgcctaagggggcagcatggaagatgtgtctaaggtgccaggcatggtggcgtgtgcctgtagtcccagctactccggaggctaaggccagaggatcacttgagcccccaggagttccaggccagcctgggcaacatagagagacctccccacgaccaatctcaaaaaaaaaaaaaaaaaaaaaaaaattcctaaggagcctgaaaaagagaagcaccgcctacctctcaagctagatgcctgttctgctgttgacctaatcataaggggcctgtgggaaccttctgcgtggaggacttcagatgtaaacagacttgtgatttgtacagtaggaagccaagaggtggcagggctcactcctcactccccttctctcctaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggtgagcagcctcagaagggggctgggagtggagaaggagctgggtcctggagggcactgaagctggcagtttcagccactgagcttgcggttgtgagcgtccagagcaagccccagtgtctggggacgtgagctgcaccattactaagctcattagtcaggtgtgctaggctggctgggtgggctgattagtggtgatcctgctgtgtgtgcttaaggagggtgtggggccacctttggttcacagcagtccaggccatgcacagctggccctcagagatgaattgtatgagaccaggggcacccatcccccacccctcccaaggaaaggagccagaaaccagcccacgcagaactagggaggagtatctggcagacactgagaagacaagactctcaggctgcagagaggggagaggagggagagagaaggggtagggggaggttagcacaaagatacagggcctcctcccctaatggcgctttccgggaaacctccacacgttttctcaaacaactgtgtctgtccatacctctgcacagtcacacctgcacacccacctgggccccaagtttcttgggcacataccctcacatgcttgtaaggcttgcttatttgtgaaacaaaggcttgcttatttgtttctggttgaggcttgaattgggcaaaaaagatgggagtctgagcttggtctcatgtgctggaaggtgccagggaaatgggcgctgagctaggttctccagcaatttgaatcttgacaagaggtggactatgagacctcttggaagcaagtgcaggtcctgttcaggaggcgctgaggtggagcagattagagaggaggttgggttcacttccttccaggtgtgcgtggttgggaccctcaggcaggcagcctgataataagcactcactgaactcctactccacaccacactgtgctaggca

SEQ ID NO: 12440 - DNA, 17043 bp, Homo sapiens
ctacagttgtggctacaataaattttgggaacctaaggcaagtcagctttaggaataagagtctgctttaaattaaactaacttgctcatgcttgtgtacttatgaatttttttgtaaattatgaaaaactggaactaaatgatgggtttacataacatgttccaccccaatctcttgcttcattttctgcctgttcacaattcattgctattaaggaaatctacagaagtgcctttttatgctgttgtgttgacctatatatgcctcatctcatggttaatccagtttcataacttcagaaaggatttctgagatgacctttcctttaccttatcacgtaaggaaagccaagtagtaatagaatttcattcagcttaacaatcacttataccctgcttgtttcaggcttacaattgtctcagaaacactatgaattcctgggagccagggatcacatcttgtatctgtgtttaccacaactgaacacatttggttgtgagaagagtggggaaagacactgaataaatgctttaaaacaaaatcatcatcacaaactataaagaatataaaacgattattatggaagataaaatatatttttaattacttcaacagaaggaattatttaaacgcaatatttatttgcttctggaggacatttatgtaaataaaatttaggtagtgttcatcaaactgtgaaaatctgtggagacgcgtggtggcgctgcaggataatatcaagaaaaaaattaccctggaggatgttgtagaccctgttatccagtacacgcggagaactgggaagacagaaagaacaatcctttaagggagaacctagaagccattcaacaaggttaaaatctttaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgaggtgagtgagctgtcttcgcggggggctcgggtggtttctaatgataacaaagagtgtttgcagctggacacaaacactggggatttgctcctgagagaaatgctagacagggaggagctctgtggctccaatgagccttgtgtgctgtatttccaagtgttaatgaaaaaccccacgcagtttttacaaattgagctccaggtcagggatataaatgatcactctcccgtcttcttggaaaaagaaatgctcttagaaatcccagagaacagtcctgttggtgctgtgttcttgcttgaaagtgcaaaggatttagatgtaggaatcaatgctgtaaaaagctacacaataaatccgaactctcatttccacgttaaaataagagtcaatccagacaataggaaataccctgagttagttctggacaaggcgctggattatgaagagcgcccggagctcagtttcatcctcactgctctggatggcgggtcccctcccaggtctggaactgccttggtcagggtggtggttgtagatattaatgacaactcccctgagtttgagcaggctttttatgaggtgaagattctggagaatagcatccttggctccctggttgtgaccgtctcagcctgggatttagactctggaacaaacagtgaactatcctataccttttcccatgcctcagaagatattcgcaagacatttgaaattaatcaaaagtctggtgacattactttaacagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggtaagtcttgtttgagatattttaaattgctttccattgttttcaatatttactgtgacttttgttttctgagttgattagaatgctgttcgagtatacctaccctagtttcagaagcatagattgtagtgtacctttttaaactttatttttttaaaaaaagttgttttatgaatcatacactattttcacacttttaatctcagaagaaacatatgtgacatggtattttagtaatgaccaaatagacggtcttagagattcagtaagttcactaaggtccactaactaataagtgacaaaactgagcatccatcctagatctgcctgactctaagtcagtgactttgctcccattccatactgtttttgtcattggatatcacctggcaagtttctgcctaactaaagagaagaaaagtttttatcgtattcatactactgttcaatctttatttagaaataaactttatctatgatttcattttcttataaaccagtaatcttgcttttctgggtaaattttcagctattattactaatgctctgatctgcccaaatcttaagtaaaaaacaaaattgaaagagcaacctgtgccttctcattgtctcctgaacatataactatcatttcacagaaaagattaatggtcctgattaggaatagtacataattttgatggcattattagttaattattttctttacattgtagtatatttccagagtcacccatgcttacatttgtaatatattttcctgatttgagagtttgtttttagcagtttttcttacctatactgcactgctgaatcaggaaaatttaagaaaaagaatagatttaaatgtgtaatatcaaagagaaatatagatgatcattaaatttttagaaattttggggagttaaggagaagcattgtttgttaaaaatatataaccgattcttatatttaaaataggtaatttttgcatagttgtgttctaaatatattataaactagtgccagtaactctaataaagctagtattactgcatatcactggtgggatagaatctaaggacaaaaactcacagtagtaaaatctaaaattgctttcatggtctcagggtaaaattatccaatttctctgacaaataaatggctcaaaaaataagaggagtgaagtttacacaaggaaaaatcttaagaggtctaccactcaaatacaatgtgtggatcttttttggatcttgattgaaacaacagcaatgactttgaaaaacttggaagaatttgaatatagatgggtattaaataatgttaacttgatttttaggtatgataatggcattgtacttaagcatatttttagagtcatttaaagtcatgatgcttttaaagaaatgtataatgacgtatttgtgggagaaaattcagtttgtctgggatgtgaaaatgttgaagggatagagtcaagaattatggcaaaacattgataatagttgaagctagtactgagtccttggaggatcattatactcctctcttttatgagatttgaaaaatttcaaaataatgtcttttaattgatgctgttagaagtggaggtaataaaaaaggacatccttcccagaaacaaaatcaccactgctgttacagatattgtctctatttagacaaactctccagcctttccttgttcatttcctttcattattggacataacctctctacctgagatagtcatgctcctgtattcttctaccatttgaatttcgaggtgtttatctagttatagtaatggatttatgctagacttatgatggatttatgccatcaagactcagttacttgatggcatcaaattgctttatacttggtatataccttatttttaaggttaatatctatttgcattagattcctcatgtttaaggtggggaattcacaacagccctatgtggtaggtactgttcttatcctcactttacagaggagcaaactaaagcagagagattaaataatttgttcgaggttcacagctactaattattcctatggttcatggaaataaaactataaagatctaaatgttgtccatgataactacaattatatttgaaattctttttgccaagctagactattacctaaatatttcctttttgcccaaaactcagttatcattgttgaaagactaatgtgatttctcctttgggcagttgtctgctcactaaagtccggcgatattaacggtggtgttgtaaccttacatagtctcggggtgcatacaggcagagttgggaatattacatccattatcattccacaaaatgtaagatcctgtgaggacgcgtggtggcgctgcaggataagaaggcacaaaccagaaccgcagctgcagctccattaaccggcaaaaagcagcagaacctggaagtccacggggagcttggatgccaaaggsaggacgrctgggtcctctggagaggactactcactggcatatttctgaggtatctgtagaataaccacagcctcagatactggggactttacagtcccacagaaccgtcctcccaggaagctgaatycagcaagaacaatggaggccagcgggaagctcatttgcagacaaaggcaagtccttttttcctttctccttttgggcttatctctggcgggcgcggcggaacctagaagctattctgtggtggaggaaactgagggcagctcctttgtcaccaatttagcaaaggacctgggtctggagcagagggaattctccaggcggggggttagggttgtttccagagggaacaaactacatttgcagctcaatcaggagaccgcggatttgttgctaaatgagaaattggaccgtgaggatctgtgcggtcacacagagccctgtgtgctacgtttccaagtgttgctagagagtcccttcgagttttttcaagctgagctgcaagtaatagacataaacgaccactctccagtatttctggacaaacaaatgttggtgaaagtatcagagagcagtcctcctgggactacgtttcctctgaagaatgccgaagacttagatgtaggccaaaacaatattgagaactatataatcagcccyaactcctattttcgggtcctcacccgcaaacgcagtgatggcaggaaatacccagagctggtgctggacaaagcgctggaccgagaggaagaagctgagctcaggttaacactcacagcactggatggtggctctccgcccagatctggcactgctcaggtctacatrgaagtcctggatgtcaacgataatgcccctgaatttgagcagcctttctatagrgtgcagatctctgaggacagtccggtaggcttcctggttgtgaaggtctctgccacggatgtagacacaggagtcaacggagagatttcctattcacttttccaagcttcagaagagattggcaaaacctttaagatcaatcccttgacaggagaaattgaactaaaaaaacaactcgatttcgaaaaacttcagtcctatgaagtcaatattgaggcaagagatgctggaaccttytctggaaaatgcaccgttctgattcaagtgatagatgtgaacgaccatgccccagaagttaccatgtctgcatttaccagcccaatacctgagaacgcgcctgaaactgtggttgcacttttcagtgtttcagatcttgattcaggagaaaatgggaaaattagttgctccattcaggaggatctacccttcctcctgaaatccgcggaaaacttttacaccctactaacggagagaccactagacagagaaagcagagcggaatacaacatcactatcactgtcactgacttggggacccctatgctgataacacagctcaatatgaccgtgctgatcgccgatgtcaatgacaacgctcccgccttcacccaaacctcctacaccctgttcgtccgcgagaacaacagccccgccctgcacatcsgcagcgtcagcgctacagacagagactcaggcaccaacgcccaggtcacctactcgctgctgccgccccaggaccckcacctgcccctcacatccctggtctccatcaacgcggacaacggccacctgttcgccctcaggtctctggactacgaggccctgcagggkttccagttccgcgtgggcgcttcagaccacggctccccggcgctgagcagcgaggcgctggtgcgcgtggtggtgctggacgccaacgacaactcgcccttygtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagctcggtctgttcggcgtgtgggcgcacaatggcgaggtgcgcaccgccaggctgctgagcgagcgcgacgcggccaagcacaggctggtggtgctgrtcaaggacaatggcgagcctccgcgctcggccaccgccacgctgcacgtgctcctggtggacggcttctcccagccctacctgcctctccckgaggcggccccgacccaggcccaggccgacttgctcaccgtctacctggtggtggcgttggcctcggtgtcttcgctcttcctcttttcggtgctcctgttcgtggcggtgcggctgtgtaggaggagcagggcggcctcggtgggtcgctgcttggtgcccgagggcccccttccagggcatcttgtggacatgagcggcaccaggaccctatcccagagctaccagtatgaggtgtgtctggcaggaggctcagggaccaatgagttcaagttcctgaagccgattatccccaacttccctccccagtgccctgggaaagaaatacaaggaaattctaccttccccaataactttgggttcaatattyagtgaccatagttgacttttacattccataggtattttattttgtggcatttccatgccaatgtttatttccccyaatttgtgtgtatgtaatattgtacggatttactcttgatttttctcatgttctttctccctttgttttaaagtgaacatttacctttattcctggttcttaaaaggtgacaattcattctttaacccagatggtcttaatttgtaattaatttgcctccctaaagagcaataccaaatcacatttttttcatgcccctatctttagctgaacttcacccactattatgcttatggtaaaattaaatagagcaatttggaagtgattccaattttccagcatttcttcatttgattctctttttttagtcttaaaataatgactcctattcagacatatcatttttcttttttgtaaatccagtgcgtttttagttaacctttaaatatgctttttgctttcaaaaataaaccagaaaacctatatcctatgatacaactctaagtgttatcacttgattcgaaagggtcagaagaccagttttttagtatcctttcctcattcatcctggagaggattgtgcaggcacattaatattgtgrccaatcacagaatctgggaatatgaagctataattttttaattaatgtcacaaagctctagtgcaatctagttgaatgcagatgcctgtgcccaaataataattcatatagcataaattggagttgtgtgttaatgtgtaaaaatttttgcctgtactatcatataatttaatgtatatacaccagaaactatttttcaaactttttttactgcaaccaatagttaagattatattttacatattttgaaacacacaagcttaatagaaataaatgcttgtgaacaatgcttagtctttttatgacataatttgaaattacctatatatttcattctattcaattttcaaatgtggtcatgatccactaaatttatttcatggtatactagtgggtagtaacccaaagtttgaaaaccacttttctcagacatataaaagcataccagatgttgaacattgatagtatcaaaagatagtcccttagggttctaattttaaaaaaattttcaaagcattgtaggggagtagctttgtctcatgttaaatcactcttacctttaaggatctgacacactatgtaagaaaaagacttcaaggttggaggaggagattttccatgacttttatcaaagtctacagtctatgttgtgggagaaaaatgtagaataacaaaatgagtaaaagtatagaggcaaaacaagcatgtgtatgagagagagagagaaagcatggaaaagaggaaattcatggggatgagcaaaatgactacttccagtgccacagactagactcagttgcttctcttatgttattttttgagacaaggtcctgttctgtcacccaggctggagtgcagtggtgtgatctccactcactgtgatctccactcactgcaacctccacctcctgggctcaagtgatcctcccacctcagcctccctagtacccaggactacaggcccaggccaccacacccactaatttttgcatatttagtagagacgaggtttcatcatattgcccagactggtctcgaattcctgagctcaagcagtctgcctgcctcagcctcccaaagtgctatgattacaggtatgagcacctggcctcaactacttcttgaagatattttaaaactttatcttaacattgtagagggactgggtattagtcagttgataatgccaagaagtgcaatctcttttaatagcatatctaagacaacctaatgtttatacttctgactcagatttcactactggttctgttgagctttgtcaactgagtaattattcttttcttttttctttctttgtttatgttttagagacagggtcttagtcacctaggctggagtgcagtggtgcaatcatagctcactgaagccttgacctcctgggctcaagcaatcctcctgacgcagcatcccaagtagccgggaccacaggcacatgccaccccccacagctatttttgtttgtttgtttgttttttgttttgttttgtttttgagrcagagtctcactctgtcacccaggctggagtgcagtggcgcgatctcggctcactgcaagctccgcctcctgggttcccgccattctcctgcctcagtctcccgagtagcacccccagctattttaaaaaaaatttttgtagagatgggttctcatcatgtcgcccaggctgttgaacttctggcctccaaaggtgggagttattctagcagcttccctgtgatcttctcatatctactggtggagtgggaaagagtagttcaaacaactcagacagaaaatctcgctggtgcaacagtggagagaagggccaagtacttgtyctgttacttccagtttttctagatatatgagcagcaggactcctctctttataaaaagaactatgagtttcctggctctaatgaagagtgaccaggcattcaggagctcaaatgcccagatacatataaccaaccaattctcctagaatgcattgctaaaaacgaattttgcttatatgcttcaaagacctcatttatagttatacttaaaacagtgcataggaatcaagctgtatcagccaattttatatgaaagaactataggttgtaagtaacttagaatataattttttatctagcgggggttaaaggacacttagaaaatagagacacaagagatggcccagccttacagaatggattctcctgaaaacgcttacaataaaaaccaaataacagtattttttttttatttaggcaatagtatgggagggaaaagggacataggacattttatcttacaaacacattgttctctttatctttctgtttcaagttctaccaccactcctgggtccactgattaatctaacaacatggcctctcagtccctaagtctttacctctactcctgtttttcagtcattaatgccctggctacatattgtactttttccccaccaagaaactgttctatgatataataatttcagctatctccctctgagtgcacaattgtctatgcctataaccttctcattctgctgtttctatcacatcttgtctttgaccttatcagagctccattccatggtgctgttactacctatcaaacgctcctgttttaatttccttcctattcagctgatttcctggtttaccactcccagttgctctcatgcccatattctcaattcccttgttcaattttccttcactaaaaccacctgatgaaactccagcccagatgaatatagtcctcctcctctcttacacatggggtgctgcactctataagaccaaacttacaaaattagcaataccactgccactataaatgtataatattcaaacctaattgggcttctgagaccaagaactccttttataatttttctaacgagctttctcttctacgctccacaacaactattttaaacctacgtatcttactttaaacttcttaccctaccacttagatacccccttttatccgatgaacttgcctgataccttattgagaaaatagaatccatcagctagaaattcattttcctgtcccctactccacagctttaacagcatctgtatctatacttttcacctgctgaggtccgtcccactggtctaaatccaaacacttcatacattgcctggatcccatctttaacaacctttctaggggacttgcattatcccttctgtatcttaattttctccttccctactgaacattacacattggcattttaaatatattcaagtttctctagtctttaaaatactctctgagtctgaattcttctccagataccaatgtatttcttattccttttacagccttttcattctttacaaatttcttgagagcctggatgcagtgagccagtgagcctgggtgacagactgagaccctgtctcaaaaaaaaaattgttgaaagagcggtttacctcatttttgcttcctcatccgcctcactttgcaccgaagtacaatctaattttcatcacaaccattctactgaaactgctattgcaaatgttatcaaagatttccatataagttaagattatactgtggaaccaatgtgatgcaatgacacagtggcttgtaaacatgtctctctttttcacatgacagtaccaatgtaaaaattattaggtaggtagggcagctttcatcctcacagtccttctgaaaccaaattttctttcaagtaatttcttcaacattccctatggcaatataatctgcatggctgtagctgggtcactgtcacatctgggttctagctcgcttggaagaaagaggcatatccagatgatttctgttctataactggaaggggaagacagaaattctgctcacaatccatctgtgagaacttaattcacttggccacactcaaatacaagggaggctgggatgggcaatctaccttcatggccacatacctgggcacagttctattactatagaagcaaaggaaaacagattttgtcagacatctatcagaatcctccacaatgaccatctttttaagcccactggataattgtcatacttatttttcttgatttttctgaagcatttgcagccattgatcttccttatctccttaaaatgctatttgcttttgatttcatgattttgaactctgagccttctttatcttttcaaatatacttcttgccctgtctcctctaaatgaagatgtttctcagagttctgtgccaagcctcttttatacttatttgacacacttttgcttggttatcctagagcattcatggtgtgtatatatatatatatatatatatatatggtgattgaaaccatgaatgctatatatatatatatgctatatatatgctctctgtatatatgctatatatatgctctctctctatatatatgctatatatatgctctctctctctgtctctctctgtctctctctatatatatacatatatacacaccacagttcatattgccagctcagatttatttcctatgctttggttatatgcaaacacacacacacacaccccaccaccacgcaaacacacatcctacaggcacttacctcaatatcagcatgttcaaaactgaacacttcatctttttccaccccaatcatgtttttttttagcattccctgtcctagtgaatgacaccactagtcatccagatgcccagtccagaggtgtgatatcatctctgagtctttcccatttttctccccatgcaacctatcaaccaacagttgaaaacatttcatctcctcatacctttctattcatccctcttctctccatccacactggcattatcctcatccagatcatcatctcttatctgatctccttgattctccagtcactccccctgaaattaattctccatactgcagccaaactgattttttaaaatgcagatgtaatcatgttaatcagatatttaaaacccatctttgtacttgaattacctttaggataaattcaagaatgcatgatatgacctgtataatgattcatgttctcaccatgcttttaaccctaatttcattgttagaccctccccttccatagtttttaaagtccaaggcatacttcatttctctgtgttcctcaaaatgcccatctgaaatattcctccttctcctggctagttccttcagatcacaatgtatttttcattacctcaggaaagctttcactgatgtcccaagtccgactttgatcttaattattttatttttgacagacacttaaccagcacttacaaaccactttgtaaatattaattcattagatgcctacgataataatcataggagacaaatattattaccccattttacaggtgaggaaacaaaggtatctataacttgcccaagcttatagatagtaagtcacataaccaggattctaatattgataatttggttccagatcccatattcccaagcactaaggtatgcagcctcctaggtacaagaagtcttttctaggtatttctatattactttttataaatgcatacattatgacatacttcgtttacttgtctgccaatttttctagcttgtgagctctgtaagagcaagaattatctctaacttatttgtgccatgtccttctttatatttttaaaatataaaagtgaaaaaagtaatgatattaccaactatagctgacaacaagtatttacaagagtgaaggagataatatatttgtaattactcgagaaatgacttaaataaaaaattatttcttcagttcagaatattttaacagatcctttagtgccgagcattcaaaacagtgataatgcagtgtatggacttttctggattcaaattcaaacaaaccaacagcaaaggacattttggagagaactggggaaaaccaaatgcagtataaattacaccaaggaattattgctcaagttgttgattgtgaacgttttattacaattatcttttagaaggccttacctattaaaaatacttagtgaagtatttaaaggaaaaaaaatgatgtctgggatttgtttcgaatgttccggatgtatttatgaattactttttcaaagaggaaaacttttttaatgaaaaaaaaaacatggagacacatggtggcgctacaggataagacgaaaacagtacataggctggcacggtgagcttcgctattcaggagaacagaaagcatccaacccactgaaaagacaggcattaaaggagcttcgcctacagagctgctggaggatacactctccagggggttcctgttaaaaaccagagcttcagcttccaaaattacggctgagcttcagtttttccacaagagattgcctaaaggaaccatggagatcagaggggcactcgatctgcgaaaaaggcaagttctaatattccttgttttgctgggattgtctcgggcaggtactgaatctgcacactattctgtggcagaggaaacagaaattggctcttttgtggctaatctagcgagggacctagggctgggggtggaggagctgtcttcacgtgaagcccgggtagtgtctgatgataataaaaagtatttgcaccttgatttgctgactgggaatttgctcctaaatgagaaactagaccgagacgagctgtgtggctccaccgagccctgtgtgctgcattttcaggtggttttggaaaaccctttacagttttttcggtttgagctgtgtgtcaaagacataaatgatcactcccctacatttctagacaaggaaatacttattaaaatatcagaaggtaccactgttggagctacctttctaatggagagtgctcaagatttggatgtcggaagcaacagtctccaaaactacacaattagccccaattctcacttctacattaaaattcccgacagtagtgacagaaagatatacccagagctggtcctagatagagctttagattatgaacaggaagctgaactcagattaacactcacagcagtggatggtggatccccgcccaagtctgggacaactttggttctcatcaaggtgttggacatcaatgataatgcccctgagtttcctcagagtctctatgaggtgcaagtccccgaggacagaccccttggctcctggattgccaccatctcagctaaggatctggatgcaggaaactatggaaaaatatcttacacatttttccatgcatcagaagatattcgtaaaacatttgaaattaatccaatatctggggaagttaatttgagatcacccctggattttgaagtaatacagtcctacactataaatattcaggcaacagatggtgggggtctttcaggaaaatgcacccttctagttaaagttatggatataaacgacaacccaccagaagtgaccatatcgtcgattacaaagagaattccagagaatgcctcagagaccctagtagctctttttagtatcctagaccaagactctggagacaatgggaggatgatttgctctattcaagataacctcccttttttcctgaaaccgaccttcaagaactttttcactctagtttctgaaaaagcactggacagagagagccaagccgagtacaacatcacgatcaccgtcacagacttggggacacccaggctgaaaaccgagtacaacataaccgtgctgctctctgacgtcaatgacaacgcccccaccttcacccaaacctcctacaccctgttcgtccgcgagaacaacagccccgccctgcacatcggcagcgtcagcgccacagacagagactcaggcaccaacgcccaggtcaactactcgctgctg

SEQ ID NO: 12441 - DNA, 51841 bp, Homo sapiens
tcccgccattagagcctctggcctgccctctggccctgtgggaatcagtgggtaccctattttctcacaatggccaagtcagaacccccaaggcttctcccccattcaccaggaggtccaggatcctgccctgggtgccaggagcacaggaaggggttgggtcaacatagggagctgagcagactcagcagatgtcaaggactctgacctctggaacggcacctatatataaaaagtgcctaatagatgtttgttgaatgaatgaagactttggatccaaatctggcttcttgtgactttactgtgtcaccttgggtgagtcactgcttctctcggtgctgtggtttacccagctggaaagtgaaggggctggattgatagtttcgggggcccttccagcttgaagttgggtgatcctggagagcaagtggaactgtccctgtagtacccgggggtgctgggaggggagaacggtctcagacagggggttacaagaactgggctctgctgatcctccctaccttcctccatggggttctaggtgagctcaggcacagcaggcagcgtgtgtgtgtgtatgtgtgttagggagaggtcccccggaccagaagagcccacagctggtgtcggcaacacaagtagacccagaacctaccctgattggtcccaaggcctgaggcaggcaatttccatgccttgatggtggcaagcctcactggggcccacattgcttaccctcaagggcatcaaatgacttccccagccagagttattccctccacccctctccttacccaccaacacaaaataaccaatgctgggggctcaaactcatggcccaagagctaggtctggtctaccgatgggttttgtttgacctcagtattctgtttctgagaaacactgacttaacgcatgagcccagcaggctctgtcccctctgcagcagttaccacccctccctattttctcccagctggtagcgtcacacatatctattatctgcctgccctcctgaaggtgcctgagtttggaaactctgatccagcttaacaacccattttgtaaatagggagactggggggttgtcgggggtgatcctagtgtttccggatgaacgaggtcaggctgcttgctctcgtggtccaataaggagatgcagacagactgagaaagaagggagtttatttctgtaaccggttacagggagaagatcggagtaactcaccagaccaactcgaaagtacaagtttttcccccagtgttgtctacattctaagctgtatgcctacgtgtgggagtatacgttgccagagagtaggtctgtttcattccatctttatctaatctttagggtctagggtctgggaagctttttctagagccttggaaagtttcttaatctttttttttgagacagagcctcactctgttgcccaggctagagtgcagtgacacaatctcagctgactgctacctctgcccctgggttccagcaattctcatgcctcagcctcctgagtagctgggactacaggtgcacaccaccacatctggctagttaatttttttttagtagagatggggtttcgccacgttgcccaggctggtctggaactcctagcttcaagtgatccacgcacctcagccttccaaagtgctgggattacaggcatgagcccctgtgcccagcagaaagtttcttaatcctaagtgggccctggtatgaggtgtatgtgtaagaatactttcattatttcatcagactttcgggtctgagaaaacccaggagcggtcttaacaggtttgttttcacattccagccctcatactcgggcaccattttcttcagttctctaatgtttaacttatgcattcatcagaatgagaggaaagggctctctctctctgtgtgagagagagagtggctgctccggctgttaatggaaacccagcttgccacactaggttcatggaatcttagaccatagacacctgttttcctgggctctgtatccatggagtaaacttagaacttgccttggtgcctttaggtgtgatgtactctgcagatcaataacatttgcaataggaaagattatttcaaaaagatcttcaaaatcaaaagtaaccaaataaatgtttatgtcattatcactaaggtctcatttccagctctctactccaatatcatttcttcagattggccttctctgatcacttgactcaaaacagcaccccatcccctcctctcttctattttatttgtctgaatcacttcctggtatcacagtttttatcccaccagctttctacctgcctgctctccacgatgtcccacgagggcaggggcttggtctatcttgttcactgtggtatccccagggccagaataatgtctggcacattttaggtgctcaaaaaaaattgttgaagaacagggaaaatgaagccctggccattgtagccccagcaccagccaccttccctatagtggtttcttgggttgttccaggggcttcctggggtcgtcttacagtcccctagtcaccgggcagctggcaggcctctaccctgcatggggccccgtttcaggctaagtggggccggcctcccagctttatgtcctccttcagaggggaaggaggcagtgatgtcacagaggtctcccaccctcgctcctccccagtctgaccgatcaaggctgaaatcccaagttcaaagagaccacagcatgggtgtgcaggatgtgttgtttgtgggttgtaggtagggcaggggcccaggcaggtcatggtgtcttaaaagaatgttctttgagctggaagactgaaaaagggaggcggggaaggaatagcagagggtggggagagaagccaaaaggaggaaatgcatcttatttttcctcgaagagagaataatgagggtggcttcatttttttttttccaacagtaaaaatgttgtttgctcatgaaagtgattcaaacaacacacaaaagcatggggaagaaatgacctgatattctgcctcccagggatctagtcagcaatcagcccaccagggtcagatggcctggggttgaatcctgatgggaccaacttccaaccatggacttgggagggtccccaacttctctgtgcctcagtttcttttgctgtaaaatagagatgtgcttatcctcctctcttcctctctgcctccctctgctcttccctccttgcccccctttctctttcctctttcctctatctcaaagaacattcttttttttttttttttttcaagacagagtcttgctctgttgcccaggctggagtgcagtggtgcaagcttggctcactgtaacctccacctcccaggttcaagcaattctcctgcctcagcctcccaagtagttggaattacaggtgcctgctaccacatcccgctaatttttgtattcttagtaaagacggggtttcaccgtgttggccaggctggtcttgaactcttgactcgagatccgcccgcctcggcctaccaaagtgttgggattacaggcatgagccactgtgcccagcccgaagaacattcttttaagacaccatgacctgcctgggccctggccctgcccacaactggccaagggcacatcctacacatccatgtggtctgtttgaacttggcattccaggcttgattgatacctgccacccagtattattgtgaggattaggtaaatgaatacatggagaggtcttaaaacagtggcacatggtgagggccatatatgtgtttgcatcaccattattgttgtcatcatcaccatcatcaccatcatcatcatcatcatctttttagacagctctttatgcaccagcctgcctttcttcctgcctccctttttcctatcgttcacctatccatctgtctgtccatccatccatccacccacacatccatccatccatccacccacacatccatccatccatccatccatccatttaatcttctctaatgggaacacacccatgtgctctgcaggaaactgcttgttccactctgcattccattccataagaaatggacacgtttatgtcaataaatgctgttaaacaaaatgactgaggtcctggtaaattgaggtttggggtttgggtgatggaaaaccatccctgaacacctgtttccctgggttctgtatccatggggtaaaattagactttgtcttggtgacttcaggtgtaatgaactttgcagatcaataacatttgcaataagaaagatggtttcaaaaatatcttcaaaatcaaaagtaaccaaataaatgtttatgccattttactatttcctgcctccctaatcaggctggggttcctgcagccagggactgtgtgtcccccacatcttccatcagactgacaactcctcaggcaaggctgtttctctctctctctctctctctctttcttgctctttgctgccctgccaccccagccctgtggacactagagttctggtttatgtgccccttttcccactctgtataagagccccctggaagaagaggaccacattactgaggatgggtgtcctgcgattccagagcaaacggctcttctcatcacccccaatgcccgatatgaagggaacacgtcacctgcaattcaccacctctaccccaagctctaacagacatctcatgtcgaacaagtccaacagagaatggccaagctccctgcccagcttgccctcctgcagccttccctatctctctgatgacaactccatccttctagttgctcgggtcccaaatactccagtgatcgttgaccactctctctcacacccacatccaactcatcagcaaacctcatcggctctaccttcaagatacattcaggatccaaccacttcccaccaccttccctgttaccctgggaccaagccatgccatccctcgcttagataatgggaagaaccttaatgcaccatctgatgtcatacacactttactcatttaacttcacctacggtctgtctcccccagaatataaatgtcgtcagagcaggaatcatggtctcttttgttcatagttgtatccctatcacctaaatgagtgcctgacacataaaagatgattaacaaacacttgtcaaattaacaaatgaagttctacaaagagcctcagaacaggctgaagcttgctgtgctgagctgaaagaagagggattttcagaaatgagtccacgctcccaggtcattgctctgagctctttttcaagttccctcctctctggctccccaagaatgcttgcctggggtggcttctgctgtctgtggagtctgggcacaagggcctaccctcacctgttggggggtggtattgtgtggcgagacgggtgaacctgcgtggaagttataactctaccacttactagcagtgagacctgcagccatggttctcttacctgcaaaatgaggataaaagtcataattgttagtgttttagtgaacacaggtgccaggagctgtgctaatcttcttacacataactcatgtctttcccacatcaacacaatgggacaggtactactgttacagctgccaacttacacatgaggcagctgagtcacagagaggttaaaaggtttgataaggatcacaggtggttataggcagagcccgcacatagtcagcccacagaaacactgacatcattgtaataggggttcaggcaccaggagtctttggaggggagggcagaggctgctggggagctctggagggtctcctgtcagcaggtgagtcctgcttcgcccggggcccccagttgaagctccccttccccatctcccagacaggccttgggcacctcctcccctgacctcctggattgacagccctgagtgaggagggtgtggagccaggaggtggggaccaggctcagccaggctaatcaggtcgcagggtgaaatttaaagggaggaggaggcaccagtccatcagaactcacacttcttcctggcaaagaagtgyccaggaygggagctggggagccagggctgatctaggaggctgggagccaggtgacaggatggccccaaagagagttgtgcagctgtccctgaagatgcctacccatscygtgtgtgtggtgggagtcraggcacatgtggacattcacaggtaagagctgggaggcgctctcctggctgcagagagctgggttagagtgtaagtcaatggggtgggtgcctggtagacaagtcaggcacgttggaaaggatgctggcaggagatagcagagaaggtggagttggctgtggagtctggaaggaaggaactagggtctagtcaggtcctccttggggccccagctcctgggcactgggctcaggacattggcttcaatcccctgggtaagagtccagccttagatttctaactctgagccctggggtcaggctttggggtctgggccctgcattctgacacctaggtagaacttgtgtggaacatcagatggctcaagatggggaagagaactggttcccacctccctcaatttcttgccaagcccccatctctttgaggtgaagggacgtgtgtggtagcttgacccttggaggtcagccagagataactagattgattccaatcaggagggagtggttaggaaatactcgatgaattaatatgaagagagaacctggagcaagacggctgggacttatgtttgctgtgagatgatggtgatgacgctgattatggtgatgaacagtgatgatggcratgatggcggtgatggtggcaatgatgacatctgagggggcatcagtagcatttgcttctcctgttgacccaaatctttcctgtgctggctgtgtccagatggggactcggggactcagccttagtttccctacctggccactaagggaattggatttggtgatctctggtggcatttccaactctgagaggctgtctatggattccatccctgctggagcaggtggggctgaaccccttgcagatagggggctcgtggtgggagtctccctcaaagaggagctgggtgctgggggtctgttactgggtgagatctgagctcctttctccctcttgggactcagcccctgtacctgctggtctggttaatgtatgtggggcccagggccagctgcccacctggcctctggtgatcctctgctygagaagcccttcctgcttctctgttgggcagtggtctgtgaccccrgtggcagggctggggaggaaaaccaggagccatggaaaccaaaccttgactctaagttgctgctgggagccccgctgtgggggctggttctctcgggtytaggtggccagcagagaccccattgtctcytgccctgttaacataggcttgccagatttagcaaataaaaatacaggatgcctggttaagtttgaatttcagataaaaaacaaaaagcttttttagtatattgcatgggagatatttctactaaaataatctgctgtttagctgaagctgaagtcttttttttctttttctttttttttttttttttttttgagatggagtctcgctctgtcacccaggctggagtgcagtggcgagatctttgctcactgcaacctccacctcccgggttcaattctctgccgcagcctccagagtagctgggataacaggaacccaccatcacactcggctaattttgtatttttagtagagacaaggttttgccatgttggtcaggctggtctcaaactcctgacctcaagtgatcaacccacctcggcctcccaaagtgctgggattataggcgtgagccaccgtacctggccactaaagctgaaatctaactaggcatcccacattgtatctgggaatctactttcacaccaagagtaggaaaagggtcccttgcaggcccccttcttcttatttcaggcttctgctctcatctgagggcatggctgtttctagaaggtgatttcagaacctctggctctacactgtgctgctaaggccagaaacatttcacggggagccgggagacctggtcttagctctgccactgacttcctgctggatgtgggccaagtcacttgtcctctctgggtttcatttcctcatctgagcccccatgagatgagctgagtccactctgcagttcactgtggaggtgaagtacccagaccctggagttgaacacactccattctcaggctggctccaggcgtggctggagctgcacttccgagcctcagtttccacatctgaaaatgaagaaacaatataacaccagttataatgggttcaggggaagataaatgagcccatgcatgtataagaccccttgcgccgtgggtgccctggcagtgcgcacagctctggtagctctgtgagtccccttttctccagcatctgtcctttccctcacacctgagaggatgggaggagacgaggacagctcagactgcaagtgctgggagcatagggtgtctgtaaagctccttagcgtcctcaaatgcaggccctggcccagcggaggggcaacgggaagttgcctgggctattcatagctgttgtgctctggttggctctgggaggcagaggttgctctgggatcctgagtgagcacacagggcacctccatccaagagcccttcaggaacyttcacctgggtgttggtggtgactatggtcatagctactgagagcctccaaactaggacacagaagttgattctgcagcataaggaagagcttcctgctggccaggtctgcgatgggcagggaaagaggggcatggaattgtcaacctgggaaggtttttaagaggagcctgaagctcactccagcagctgggctggcagcaggaggaaggggttacacttgatgacaagtgatgaacttggggcctccccaaccccttcacccagtgtctgactctagctaaggccaagtaaggggtttctagttggccttactggtgggaggggggaagcccccagaagaggaggtgttgccagtcacctgagctgctgggagtctgagccctccaggagatgggtgtgtagggatgacatcacaggaagtgattcattcccccaggggctgtgtgaactggttatttggagaaacacttgtgtttggggtaattgtgtgccccagggtgtcccagcctaggaaacccttaggaatcctcgactcagcatgtgctgcaggtcccatccccacaccccagtaggctagcccaccaccctgtccacccccgactccagtgggctagctcaccaccctgtccaccacccaccccagtgggctagcccaccaccctgtccacccctgactccagagggctagctaaccaccctttccaccccccaccccagtaggctagcccaccaccctgtccacccccgactccagtgggctagctcaccaccctgtccaccacccaccccagtgggctagcccaccaccctgtccacccccgactccagwgggctagctcaccaccctgtccaccccccacaccagagggctagctcaccatcctgatgacccacactccagtgggctagctcaccacactgacccccacaccccagtgggctagctcaccaccctgattccctggatctggccagactgccctggctatccttgtccttgcctaaggagttcaggtggctcatgccaataaagacaggggtgggaagtgtgaggaatccatctgcggtcctgtgtggccctccttgactgcccagaggccagaaccagagcctgaggctggagaccataaagaacctttattctttgggatgcagaaggccggccttgtaggagacagggacattctcctgcactttcccccaagccttccccaccactgcaaaagcagcaatgcaagactgagtcaggatcagacagcggtagaattggaggggcatagggagaagggactctgcaggcctctcagatgcattttctggaattctctgtatttcagaaaatgaaaatgccaaaacagagttcgaaaacttgtggtatgtgtaatgtgtacatcgagtaaattaatgcttttaactcgcacagaagaacaatgaggcataattgtgctcctcaggggaaaattacaggattgacactgacactaatttccagcgaccgacaggctgccggcccctggctggacacattctctgctccgtcctgtcactgtgtcactgcagcaggaagaacactattcaccagaagagacattaaaagttcaagtttcagggtccctggagaatatgaagctggggtcctccgcaagttccacagggccctgacaggcccgggggttgtaaaaactggactcagaatggaagagggtagcattcttgaaacataaaatattgacatcacgaagggcctcagaggtcagccaccccttaattctgtggaactccctgctcccctgggtcctagctgccacttgccattttgggactggctgggaatctctccccctccctctggccccccaggccctcygctttccgcctccttaccccttcctggcatttcctggatcctagtcttggaatgtctcctcactctgagccttcttctcttcccttctcagctcccatcccttttacttccagctggtctttgcaggctgtgtgaccttgggccagtcacttagcatctctgagcctgttttcttcggagtgacatcccttattgtttgtacctgcgaagctggcacctttattttttccattttattttatttttatttttatttttgagatggagtctcactctgttgcccaggctggagtgcagtgacatgatctcggctcactacaacctccatctcccaggttcaagtgattctcctgcactcctctgccccccaagtagctgggattacagttatgcaccaccccgtatttttaatggagacaaggttttgccgtgttttccaggctggtctcgaactcctgacctcaggtgatctgcccacctcggcctcccaaagtgttgggattacaggtgtgagccatctcaccctgcctaagtttttattttattttattttattttattttttgagacaaggtctcgttctgtcacccaggctagggtgcagtggtgtgaccatggctcagtgcaacctcaaactcttgggctcaagtgatcctctgccttagccccccaagtagctaggattacaggcctgagccaccgcgcccggccaatttttttccattttaccttgaggaattccacaatccacagaatgcggacatgctttggggagaggatcggtgactcaygacttggactctaaattcagggccctatctctcagggacattctggtccccagccyctgtttatctcttctgggaagaccagtgagtgaaagctgtccctcttctccagcctccattcctggctgggcagagctccacttgggagaaagctggttcagcctgcgccctcagcctgggctctctgggcgtgcccctccccaagcaatgacagggcataaggcacccactagtgtgatttctgtgaatgagggagaagacaggacacagccacatcatgtgtgattctagactcctgagaaaatgcctgagcctgctgaggggtctgggacatcagccattgccctccctcaacctccagcarccccagccagccccggggagaggatgcaggggaaagctaaagccagggttgcagccaggggactgggggttggagctgccccctcctactgtctggtgcccacacctcccatctcaaggaacctcctgtggtcttttccccagggccgtctgctcccgggcacctgctctgtgctgggttctggcactcggtgatgatacggcccatggccacatgtgaggagcttccatcctagttggagagttaaacaaatttcaggatgtgggtttcaacaattgcacacctgacccattttcttggtcagggaggagagtgaagggaggtgccagggtcctattaacgacagggccctgtgtcctcttttgyccgggtctgcccactcctccatgcctttcagatgccctctgtgactgtaatgatcatgatggcagccctggtwttttgtttttgtttttgtttttgtttttttttgagacggagtcttgctctgtcacccaggctggagtgcagtggcacgatcttggctcactgcaacctccgcctcccaggttgaagcaattcctctccctccaccatgcccagctagttttttgtatttttaatagagatggggttttactatgtaggccaggctggtcttgaactcctgacctcagcctcccaaagtgctcggattacaggcatgagccaccatgcccagccggcagccctgttttaagtgctcactgcaccatctcagttaaacctcacaacaagcctgtgagatggggactactataatccccatttgcagacacgcggagacacagagaggttaagagacttttctgaagtcacacagcccacaaatgccagagctgggatttggacccaggtccacctggttctaaattctgtgagcctaaccctgtgactgcccaggctctgagactcttctatgttgctgggtaagtgaggggtgaagtgaaggcagggcagcagatgagctttggaatcagacccaggcaggggccaagcacggctgtgccccatcaccctctgtgtgacctctctgtatttcagctcattttctgtaaaatggggagaagaataatcactcccctattagcaggcaggggccatggggatggaatcagagaatggagtaaaaaccctccgtagactctgtggaccccacaagggcaaagccaaggatgatttgtctctgctttcctggtgcccagcatgggacctgatgtacagtagctacccaggaaggtacgttgaggcagagccactggcagcactaatgggagccctgtgtgccccagggaagctgctggcctttagctggagctcacggggtggcggccagtaccccgggactatcagcctccaggcagatccctggctccaggcagaatcacccacggagctggtcaccccaggagatttgctgggccctgctgcctgaccctacggcatttcttgtggcttcattccaggacacctagcggctggcacctgtggggctcctggcaggccagatcctggccaggcgtgcaggggagccacaggctcagccagcagtgcctgctcttcagccttttcrtccgattctgcctgattctccccctcctgcccccaccactcatccagcacagtgccccagacgacccccaagagcacattggcccccacccccacccactcagtttctgyccccaggatctggccatgtccaaastgcaggataggacagttggcagggaagcattcctctgtgactgctgtatttctcttctccctagagaccaggtggtacatttctgagctgttgacmtaagatttggccggtggagccscagtgggccgaggcttctgggaagcaagttgcagccacgcaaaaggaaaagctttctaattacctgaactgtcaaagcagagaggggtgtgaggtagtgagctgtcagtctttgggagtgggcagggggctggccgggatgacctccaaggcccgtctctgacccaaggcctatgctatgcaagatgctccctggtctcttctgtcattttagggcagacaaggacaagaagatcacaggcaccacccccctcgccttgccgctgtaagatgtgggtgtgtggtggggccagggggctgtggctttcctgccttggtgccgccaccctccctaggcctccctggcctgctgccaaagagccatgcagaggagctcgaattgcacactctctcaacacattcctgtttccttccgacatccctgatcgtctcctccttccagtccccgacaagggcatgctcagggcacacacgcactcattttaataccagccaggacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatggtccaggacgcattgccctcctatgcaagtaactcacaatcttcctgcacccagctttcaccagacccctgcaactgagctccccgcggcctgggcataatcagtactgcacaaagccctcttcaacagacagataaacatcgtcctataaaatccccagcaagtctttgtttctttgcagtcggcttcaccccagagagaggcttctttcttgaaggctgacttttgtgtctctggcgatgtattttcctactttctgtaatcaatctgctttcctttacacacagctgtcctggtaaattcttttactcctgcattaccggccgtcattaccctgtgacaagtaacacctaccttggtcggggagcaggagttggagtgaagtctagatgagatcatggatagcaaaagctaagcacgtgcctggcacacggcaggtgcttgaaaatgcaggctctttccctgccccactagaacccatggaacatgctgccttatgccataaccagtgggtgaacctgcaccttaccacaggaggcgggcaggggtggagagtagttggttttacactcctcatcccgccctcygcgtctccttttgtgagattctctaagaattcaccccattctgcccataacctctctattgaacctgatgcaactggccctgctgtgggcatgaggttggtgggcattgcagggtgagtaggaggaygctgctctgggcggcgcagacgagatgtgaagtggcccccaggaaggtctgaaccagggccatgggggcacagaggaagcacataaggtttctggctggagtgagttgggctgtctggggattctgagaagagtaattgtaaccatggtgacagcatctaacgctgagaagtcatcatctcagggaatccctccaacagtctaggaagtagctcttgggattrtgtccattttacagcggaggaaaatcgaggcagttgagtgacccagttggaggccatgctccacacagaacccacacttcactccatggaagaggtggcatttgaagtgggtcttgaagaatgcaaaagacccccctgccccccgccccatgacttggcccagcagagatgggggagcagcctggtgaggggcaggctcatcagcataacagtggaaaccatgatgatataacagtgattaccaagacacctgacagggtgactcctgtagtggtaatgatttggccttttttatttggaggggtgctttcaaatctgtgacctcacctgactgtgcatttggggacatgccagtactgcatatctgggggttggttaggtctgggggctacatcatgagacatcaccaaagagaagcatcttggagaggattattagatttggaggaagccgggagcagctccagaaagctggcgcaatacagcccactgcagggtggcctggggctccccacaagctcccactcctgcctgtcacacctcccaagggcagcccttcatccatgaccaggcccacagatctgggcacctgagagataaggaaaggcagtataagccccgtctcccagccccggggcaagggttggggtaggatgccaagggaatgagaatcaaaggcagcgcagggctcacccggcataacctgccttgcttgggtgccagagagaataagcagacccctcctcctgcctcttcctggtggttttcaaagctcctgctggggtacctgccgctcttctgtagctgaagctgacctggatrggggtgatgggaaccaagtcttgaaggcagtggggctgggaactagaataggcccctccccatgcctgtgggagtggccctgggcctcagacctgcatagcaggtgtctcctgcaggaagccacatttcccccaaggcctgacccctctaggcactgcccactcatctgttactcacaggggagggagacactgagaccaggagcccagcamcccagagagaggtgaacagaggtgtgagctattgagcaagtttggggtggggagggagcagatctagactacaggaagctaggctgggcttggagggtcttgatagccccagagaaattgtacctgtcatttcttcccccttctttcatcatcatcatcatcrtcatcatcatcatcatcatcattttctaccaagactccaaatagggggctgtgacttrgagatgtcaacttttgcccaaagctagggattggctccacagagtcctgcttcccttgaaagggctgtgtctggcaccggtggtccctgagtggggtggagcaggagtcacccatgagctagaaacccttctgctgccagctgggtgccctgggcttgtggctacttgctcttggaactcatgggccaggccgactggattcaatcatgactcagccacctccccgctgggcagtcctgagaaagccactccaccatcctgagtcgctgtgtccttgtccagaacgcgttgattgtgcccctggttcatgccaggcactaagctggatgcagagatgacagcagcgatgcagacagcataaaacagaaaaaaaatctctgcattttagagggagagactgcaatgagcagatatgtgctctgtcaggtggctgggaggtggccggtgccatgggctggaatgaagctggggttggggaaccagactcatggtgtcattygtgtcacgccatttgcaacaggcaagaagggtacatcagaaaggcctcgtatgctaccctgagagaaggaagtgaggggctgggcggaccgcagggattggtgacaggaacattccggacagacagagctgcagccctggcatgcttgaagaacggcaggaacaagcaagagggcgtggggagggaaagcaatgggtcaggaaagcctgggaggccacacaggctctggtgacagcctctgagcaggagggatgcaacgggacttctattttaaaaggtccctctggctgstatgttgaagctggactgtggggagagaggggaagcaggtcactggcctatgataaaaatccacatggaagcaactggtggcttggacaggatgtgagctgtggcagaggtgagagcggtcagggtctgcagttgctatgaaggtggagctgatgggatttgctgaggggctggctgtgcgagtgagggaacaagaggaggtgaggctgaattggaaggtggagctgctatggacagacttgcggtgggttgggcaggagcaggtttgaaaggagtggggaaggagtgggcatggggaagcaggagtttggctttggatgtgtgaaatttaaaatgcytggtagggctgggcgcagtggctcacgcctgtaatcccagcactgtgggaggccgaggttggcagatcacttgaggtcgggagttcaagaccagcctggccaacatggcgaaaccccatctctactaaaaatacaaaaattagctggcgtggtggtgagctcctgtaatcccagctacttgggaggctgaggcaggagaatcgcttgaacccaggaggcagaggttgcagtgagctgagatcatgcctttgcactccagcctgggtgacagagcacgackttgtctcaaaaaataaaaaataaataaaataaaatgcctggtagacacccagggagaaactcagaaagcaagaagtctgagagttctaaccatattgatgtggcaggtggagaaaaccaagggagtgggtgtagacagaagaaaggaggagaggagaggggagggaggggaggagaggaggagaggggaggctgagccctaagccaggtgcgctggggccagccgcactctgaagagtaccagtgtagggattctgcccgttgccgatggtgcctattccaattacacatttcagaacttgttggggtggggcggaaccacacatgggctcaggggctactggacccactgtaagatgaasctgagctgaaactccatggatcacctggcctccatgagcccctgctctgccaggtgggccgcagtgttgtttagggtctcctagaccagttcagggccggtgtgcaggagaactagaaatgtacgattatttccttttccccagtgacagtcaccctggtaaaaagttgtgtgtcctctcggggaaggctgggagaaagttgaacagtgtgtttgtggcaatgtaccagggtccttcctcaaggagatctgattgtttaatttttaagaaggttatgaaccccttgttaaacacagccactatttaaaattaaatatacacacaattaagcaaattatattaaaaacaaaggcagtartactgaaaactcatcactgcttaattattttactgcattttaccattgtccagatatagtggaaatagtgatgtcacgaggtgctattatgcagctctttgaaactctgagtccaatgatgttgggctggtaacttgaaactggctagagtgggagtgtttacaccacagacattggtcaaggctacaaatcagggcttcattcatcgttttatcaaatgcctagagttcagaaagtgakggagacaggttaacaatgtcaactcaatttaaaagtgtattgcgtctatagccatgacattgtggttagtaccaaaaattgatgaaatgttcctccaggattatctgattcagcaaagaggttgctcatatcctagatgaatgaatgaagggtgacatgcatcttcattgtttcccctttcatcttattcgtgaatgccaacaaaaatatcaaccaacgtttacgtcacatatcagatttagtgacaataaacttatggaggaaagaatgagcagattgggatgcaattgcattggtcaaatcatggtcaaattgcaaccacaggttggctacagttgcaagagagggcatctggaggaatcaatgtactatatagaatttacaacacattttacaataaagaattatatgtattatactattatttttacattatgtgctacacactatttacatcagtaaaatttataataaatttatatatacatatatatgcataagaacccccccactccagagagctggttgttaaacatttgccagcacaccactgcctggagttasggggtaagggggagtgacacagcaaaggcattagaggaaaggccacggagtcagaggagagcaagcagagcccgtgtcccagctgccaagtgggaaagtgtttcaaagacaggtgatcatctgggccaagtgcctctgacaggtcaatgaggggaagaagagaaaagacccactgggtttggcaacagtggagtttccttggtgtggtgggaggaaaggctgattagaggcaggttgcagacgcaaagagaagaaataattggaggtgtcaagggagcagaagaaatgaggaggtcaaaggagaatgagtttggggatgggtgatattcacgtctgtgtgctgggtgcaagggaggggagaaggggcaaggccagygatgcccttgagtaggggatgtgccccaggagggctggtcttgggcaagagcccagacagcacacccctcttcccaggagggcaggcayggtcgtggactcaaaggcaggagggctgggagatgaggtggtgggaggagggaggttgaaggctctgagtgacaagggggaagagtggggaggcttctggagataggagaagataggacatagtcctctaggacactgaaagagaaaagagcctggagcaatgctgtaggagcacragcatgtcacgcatccattgaggtcagcagtcatgagtccaagtgaaccatggtcagccgcgtggtgcaggtgcagagggggtggagagttggatctgattgtatagctggagctctgccaggcagctcaagggagggaaggatgagcaaaagattagggagtggagcaagggggtggccgcagcgggggactatgggatctatgggactatcctggggaagggaagagggaacatgagggatgagggacagcagtggggggcgagtagagaggamtcagccttcaaaggtcaagcgtcccagtgggctgaaggtttggttgcactggtgtgttaggagtgagctggaatattgggaagcggtgtccgagtgggttgctaacaggggagcttgtagtgggtgcagttttttgataataacattctatagcacctgccccgcgaaggaggggatgaggccaggtggaggacaggagcattggatgagaggtcaagggactgagggaccagggtgcagcacaccatctacatcgccattgaagtataaactggtgacggcagccggctgaggaacatggcaggagctggcaccctcgagatgaggacagagcgatggtgtgcaaaggtgtccctgtagatgggtggtgtagtctggaaatgtcaatgcaaagctgggggtttacggagtgaagaaagatgatgatctggaagggacattgaggagcatgaaggacccttgcccacctccaggcccaggggctggagggagtaagggggaagcagtcaccagggagatggctgaaggggaggccatgcctgctattgggggcaggcttcttttacagtacaagatcaaggaaactgtccagggtgggactgaggatatcgtgcagatgatggtggctgggattgaaagggagttggggaggatgaggaagggggtcagatgagaggatgatagtccaggagacttggggtttccatggcaactgatgtaaacgatgaggaagagcaggtaaggtgcgaggacccccaaaagtgcygtggaatgtggtgattgtaaggccaggagtgggggatgggggaggtgggtcttgccagcagcctgcaggggctctggggcccctgcacactcctgcctcttctgtaaaatggggattataatctttgctttggggggttgtgatgagcattagggagcgccaagtaggactcgtgattgttggaattaggactgttgtcaccgcagtcaatggagayagttttttgatggggccaagtgatcatggcagaggttgtggagggggtctggtttctccagagggctgaatatttgggtggttttttaggggtccaggaaaggatgaaggcgggagaatatgcagaaggaccccttttgcagagtggcagaaagtgagaatccaaccatttattaacaagtgtttattgagcacctactatgggccagacactgttacaggtgttggggatgcagctgtgagcaaaacagacaaaattcctccagcagcatctttgtagtcaggtggatgtctgtaagtggacttgaccttgggtggtgtcctggtggctgatggctctgccgtgggggatgatgttggagagccctgacttacaaaggaagaacaagcaccaatgtgtagttctctcattcaacctcctctccagagtgtgagcgccacaggctcaagagcctcctggaactctggggattagtgcagtgcctggcacagagaggccatagttcacgcttatgcaggggatgaagaagaatgagatgccacccacagaggccctgttggttttgctctgsgtgccctgtagcctgagtttgcagtgcatccccctctgatgctgtgggccaggaaggctggccccaaccagctgtggctgggagcagctggtggtgtgaggggtagggtgggggcccggcagatgagtgccccaggctggggccaaggcagatgggaggcttctcaacacccatttcttgatcccagagctctgatgtatcaggtgaatgcggtgtattgggtgatggaaagaagttgcacggggtgctggcattagtcaagttctagatctccactcaagtgcagatgggcttgaatccccctgcagagtggcagaaagtgagaatgcatccattcattcacacgtgtttattgggcacctacacctaccatgtgccagacactgttataggtgctggggatgcagctgtgaacaaaacagataaaattcctgcccttgtggagctgaccttctagcaagagagatggacagttgactggcattgaggtgggagaatcgcttgaacctgggaggcggaggttgcagtgagcagagactgcaccactgcactccaacctgggtgagagagtgagactctgtctcaagaaaaaaaaaaaaaaagaatcagagcaggggaagggagatgggggatcagtcggggggaaaggtgggcaaggtgcagcattaaatggagtgattgggtgggggcaggagcttgctgagaaggtgacatttaggcagagccytgaagagggtgagggaaggagacttgtggacatcttggggaggagcagtccatgcagcaggagcgggcagtgccaggacagccttgscatcttcatggcacaacaggaaggccagcgtggctggagctaagtgagcgagggaaagcgtagtagggaggaggcagtcagcaaggtggcaggggcgcatcagaagggcctcttatgctactcaagaggattctgccttttactgagtttgatggaaaccactgctttccagcaaaggaacaacacgctctgctgtgtgcaaaacagactggaggggcctgggtgggaccacggacccatgagaaagctgctcggtgatccaggcgaggggtgatggtggcttgggccgcagtgatgtcagtggaggtggtgagaggtggtgggttagtggatytctgttgagctggagagtttggaagtgtcagatctggaaaggacttgggtgtgggctgggggtgtccaagggtttaccatctatgccctggcttccagatgctcctggccagtggcactgccctgtgcctccccagcctgactgttgaggggtgccatttgaacggcctggcagccccaagcccccaccccactgtggccactcccctgaagagagatgggaagactggttctcttcccatctctcttctctgccagtgatgtgcccaagggtgccaacagcttcagggtctctggaagctccggggtggaggtcttcatggtctacaaccgcacacgtgtgaaagagcccataggcaaggcccgttggccgctagacactgatgcagacatggtcgtatctgtgggcacagccagtaaggaattaaaggacttcaaggtaagaggccactttctcatagaaaagggttggatctctccacccccatccaaggtaagagccccacattggcaattcccattccaaagctccccacttaaccaaacctcacaaagcttatcacagtacatacacaaaacgtatcctgatacaatgccactgacgcccaaaacacgcaaacctccaccaccactccagtatcacacatgtacacgtgagtactcccacaaaacacaagctctcctagtcaccccctcagattcacagacaacttcacattaatccctgtattcagcccacacacggacccagcaagatgccccagtgctctcgtgtgggcaggaccgcacaacaacaacccgtgcaggtgcacacacacacgtccacatctttgtgtgcacggatctcccacacctaagccaaccttctctctcatcgcctgcccgaagctcagacgagtccctcctcactcgccccagcccccagcacccaaatcctagacatggccctttctccccgacagggaaaaggcagggataaagcagctgttgagggaggggctcaggagcccactgtgggctcagaccccacctcctctgcttgctagctgagggactgctggactgcaggcagggtccggacagtctcctgtcgactggggccatcccaggggctcactgggatgacccggctggagggcttggcacggattctggaccacgctaaaagctccaggaccactgactggggtgatggagtgggggttctcattcccatcttattgaggaactacccgaggcttagaggagctgagagacttgcctaagtcgatggagccggctgctcctccctcawctgccagctgctcctgctgggagctgccccacctttcccatccctccacctttcccccaccctccttgctcctcacacctgctctgggaaccaaggtgggctccacagccacttgctggagaaggtagctctgaatcccagccgggagcccttgagtcttgggacttcagagactgggggggtctccaggcctcctgtgcctctaagtagggctgtcaggatgtgtccctcatcacctctgcctccgccatctctgaaggtgatggccgtgcaggcttagggctatgttctgcaggtgagrgtctcctactttggggagcaggaagaccaagctctgggccgcagcgtgctttacctcactggcgtcggtaagtagcagctccctggctgcccatctatcccttygcccctccaggttgactgtttgagggtcttagtggattccttggagtggaagacccatggccagcttcctccatcacygaggggcttgrattcctcgggaccttctgtccactctggaaccacagggattgagacccagcagtccttaggaccacaaggatctagaaacttcactgcccagtgaacaacggctagacccacaataagcctccttcatccagagtcccacgtataccctcattagacctccaagacccagcacggaacgtgcccccttcagccagggccagggtcaatgtaacggcagaacccagcccctgcaacctcaggccatgtccccagttctcagagtttggggtcaccagcatatgatttrgaaccccaaagccaccaagagctagcaggtggacatgcacaggcaagcaagtgattcaagagccaaaggcttgggtccctccaactcccagaaccacagggcaagccacagaggtctcccaagtgtggggtctgacccccagacagggcttccagtcctcacgggcttggggaggggtcagagtttgcccaacctggactttaggggtgtgaagatggggctggatgagcccctggcagcccctctccatctctttgcagatatttcccttgaggttgacacaggccgcacaggcaaggtgaagaggagccaaggggacaaggtgagacccttccgggcaccccaaggctgcggggttgaaaggcaaacttggggtggtcccgggtggattgtgccctccctccagaagaatgatggatccccagggtctgtwgtatccaaccatgtagggaacccatctgggacagcaaaattggcatgagtggacattaacctacaccctgtaaccgacatgctgtgtgactgctggaaaacagcttaccctctctgggtctctcttgtgccactttgaaattgggattggttcttttgttgctgccttttttattttgagggctatatttggacccctacacatgtgggagtgcttcctaaaagattgttgagtgacagaaggcaaggagaagacaagccttggggtagaggaggctatggtggtcagccccaggtaacacctgaagagtaaggaggaggacagagtgggctcaaggcgtcaccccacaggaastatctggaagctgtcctgggaggggtagaaggtacaatttaaagggaaagactccagagaggcagcctggatcacaaagctttgaggacaaggtgggcagggctgccatggatggctgcgtgggttgttcactgcacaagactgcttgggcatggtggcaactatgatacaaatcatgtctagggccctgctgcagagtggcatctacccagagggtgggcaagagtgccataaaggctaacagtggccctgtgcaatcccaagaacctgggtttaaaggccagctatgcggcttgggactcacctctcagaacctccccgcacccttctgtgaaatggggaaagtaagccctgccttgtgggtctggtggggaggtgtgttggggacagcagcaaccacagaggcagggagagctccagccatgtttcccgacttggctcagacctcagcttgcagagcctgcaggactgcatgcggatgccagagatatctatgggacaggttccaggagagtgctgggatgggaagggtctcccaaagattctccagatcccgaccctcatcaaggtcatggcaggcagcctctgcccacccccgccccacaggcagagctaaagcttagccagcttttgagggccatttcttggtgtggtaatgacacctttgcttctccagtgtgatggctgggtagagccattgtgtatggttgtgcaggttgctcactgcacaaggatgaggtgggtctagagccttatctggaactccattccccaaataatcctttttaaaatctttaagcaaactaaaaatatgaaaatctataatctaataaagcagcccgccctggccatgtctagaaccccttcctggagcctcctgggtcccactgatcccaaggcatcttattttgccacagaaaacctggcgctggggccctgagggctatggggctatcttgctggtgaactgtgaccgggacaatcacaggtccgcagagcctgacctcacccacagctggctgatgtcgctggctggtgagtgacacaaggtgttgtctggggagtggggaagggggatggaagtggatcctgttggtggggtggagaaagggcgatctcaagagggccactctctccagacctgcaggacatgtccccaatgctgctgagctgcaatggccccgacaagctcttcgacagccacaagcttgtcttgaacgtgcccttttctgattccaaaagagtgagggtcttctgtgccaggggtgagtggcctgatggggccttttcctcccagctccatccatatctatcctctcctcccccatctctctctctttttttccatcacctttttgtaactctcattacagcttacaaacaaccactccatcagtaccaaatatagtcctcaaggaggaggttcaacaacaacgagttccattttatggagaggaaaaccgaggctcagatgcaggaattcactrtggcacaaccatctggggtggagcaggcattccaacccaggtgtcttgggtgcaccaaagctcctccttttaccattgccccacacccgttccctcctctggtcaatcagcgtggactgaactgcatgccaagcactgtccaggcagggagggcgtgagaaccagtgaggctgaggcccgggccctgcctctggccccagaacctgtctttctcatcagagtttttattaatcagcctgtggcttaaaaaaatatggccaaggctgggcgcaatgactcacatctgtaatcccagtactttgggaggcggatcacctgaggtcaggagtttgagagcagcctggccaacacagtgaaaccctgtctctrttaaaaatacaaaaattaggccgggcacggtggctcacacctgtaatcctagcactttgagaggccgaggagggtggatcacaaggtcaggagrtcgagaacatcctggctaacatggagaaaacccgtttccactaaaaaatacaaaaaaattagccaggtgtggcggcaggtgcctgtagtcccagctgctccggaggttaaggcargaggtggagcttgcagtgagctgagatcacgccactgcactccagcctgggcgacagagtgagactctgtctaaaaaaaaaaaaaaaaattagctgggtgtggagactcatgcctgtagtcccagctactcgggaggttgaggcaggagaatcactcaaacccaggaggcagaggttgcagtgaaccaagatcatgccactgcactccagcctgggtgagtgaaccaagatcatgscactgcactccagcctgggtgacagtgcaagacttcatctcaaaaaaaaaaaaaaagaaaaagaaaaaattggccgggcccagtggctcatgcctataattccagcactttgggaggccaaggcgggaggatcacttgagcccaggagtttgagaccagcctgggcaacatggcaaaaccttgtctctacaaaacatacaaaaaaattagcctgtagtcccagctactctgaaggctgaagtgggaggatcacttgagcccaggaagtcaaggctgcagggagccgtgttcatgccactgcactccagcctgggagacagagtgagaccctgtctcwaataaataaataaataaataaataaataaataaataaataaataaattaccactccttaaccccggactgctcttacttgtttttacaaacagcaacaggcttctaccccttcccgattccccttcacccttcgctgttcaaactgacccagagcttgttgttccagctaaatgagcctggcaggagccagaatgttccctcccatgcaccagtggtggatgtttaggcagaggactcagcttaaaagtacttagtgtgacaccagggcgtaagcaaagtctcgacaagtgaatggatagcctctcttgccgtgtgcagccaccaatgtgctctctgtatctctgaaattccctatctggatatttcatataaatggaaccatacaataggcttcttttagttagcataatgtcttcaaggttcatccatggtgtagcatgaatcagtgcttcattacttttcttatgttttagagacagggtctcactctgttgtccaggctggcgtgcagtgatgctatcacggctcactgcagccttgaactcccgggctcaagcgatactcccacctcagcctcccgagtagctgggactacagacatgtgccaccacgcctggctattttaaaaaattttttgtagagatggggtctccctatgttacccaggctggtctcaagtgatcctcccgccttggcctcccaragtgctgggattatagacatgagccaccatacctgtctggtcattactttttacgaattaataatattccatcttatgaatatattacattttgcatatctatttatccatgggtaatkttcaccttttgtgccaggtgcttctatctctttatttagtttaaagtttatattggcctcatgagaaaatgttagccattttacagataagaaactgaggcttagagaggttgagtcattgagctaaggccatgcagcttgcacgtggcagarccagagaggaacccaagctgctctaaccacaaagggggctctgtcctggattcctgggcttgcagcccctcacccctgtctcctcgctagcccctgactcttgttcttcctaggtgggaattctctctcggactacaaacaggtgctggggccccagtgtctgtcctatgaagttgagcgacagccaggggagcaggagatcaagttctatgtggaggggctgaccttccccgatgccgatttcctagggctggtttccctcagtgtcagcctggtggacccgggggtgtgtacagcactggggggtggscaaggaggctgaggggtttgggggcccagtttgcaggctccagggctgggcaggctgggggctgggggggcttgaggcaggctaggggtccctgcagggcccaccaagtcctcattttcccctcagaccctgcccgaggtgaccctcttcacagacactgtgggcttccgcatggccccctggatcatgackcccaacactcagcctcctgaggagctgtatgtgtgcaggtgaggctccctccctccagccctcccccaagtctggagtgcagaggtagggacagaagctgcctcagggctgcgcccctcactcacaccgacggattcattgcgggcacccattcaggcagagctggtggcaggacagcagcaggtgggctggggccccaccctgcccaaccctgacccaccctgccctgtgcagctaaggcctctcccaggtcactggctcaagctctggctttcctgcccatcctgtcctgtggctgcagccccagaacatctcagatttagtctgggcagtggagccaggccctgcacaggctgctggtggccatcggagacctaccctcactgtaacatgggtacgatcccttgcctgctatggacatgggaacccagtctctgcaagcccgatctcacccagcttgctggtccttctgccgtctctcagaatcctcatcatgcccttgagggaaggatcagcctcgattggcaaagccctgccaggcctctgtgccagaggtcagaccactggaaaaagccacagttgagctggtcataagttaaaaggctgggaagggtgtggccaaacaggtttgctctgcttccccgggtctaggtgtgtgtaggtgttaaaaagagactgttctcctgcttgctaaccccaccctgacccctttgcttaggccaattgtgtggaacaggagtagatggggctacctgcccctcactgctattttaacccaaaagattcagcctcaggtcacctctgtggcgacttccctgactccctgtgctgggttaggtgccctgcctctgggcaccactgcccgcgcttatgcctcaccttgcacctgtcacctgatgtgatctggagactttatccatcttccccatgcgcctatgagcctctcaagrtcatgaactggaacccctgtaccccagaggctgcacagggcccagcacaaactgaaggccactcacacctcagccacagtcagaggccattagcatgctcccctctccctaccttttacagagtgatggacactcatggctccaatgagaaattcctggaggacatgtcttatctgacattgaaagccaactgcaagctgaccatctgccctcaagttgaaaatcgaaatgaccgctggatccaggtgggagctgggggcagctcgggaagcctgcagcctggcttggggaaagggaagccgcacaggtgcctgatggacccagtgtcgctagagaagccacggcagcctgggccaggcctctggggcgagggcttttccgctgcctgcatcagccccagcctccactgcttccctccaaacgctctggtcccagatgaaagtcctctcctggctggggtcctaagaggcctcacttctacctctgcccctcaccaggtcttagggaagacccgctgccctgccctgccccaggcctggtggggaccaccctgttctgtaaaccacccgaaaaaggtcacygtggctttttcatctctcccctcccaggaygagatggagtttggctacatcgaggcccctcacaaatccttccccgtggtctttgactcccccmggaacaggggcctgaaagatttcccctataagaggatcctggtaygtagmgacaggtagagtgcagaaaccctggttgggtcctcctggaggcgcaccagtgaagtctcatctggacctagtcctatagggctcagagaacaggaagagggggcagaaggatacaggaggtgggatrtcagcaaactgrggagccagtgcggagtttgggcaagagaggaaatgatatgcaaatcacatgcaaataggcagcagcctgattgttcctgtgttgggaggggcaggtcagcagcsctcttctggataaggcggctggtcaccaagggggaattggcagtgtggtcagctctggggagaccaaactgccttttggagagaatgcacccttagtgagcctgcacggctcttgttcttaagagctagggcctctctttaggtgccaaatgttttctgaacacctactacrtgccaggcactgtgctacctcctgtgcacaagatggcaacagcagcacccaccgttacktattgagttccaggcactgtctcctagctttccatggcttaccttatgtattccatggggtactcctacagataagtgctatcattatttcctctttatggatgaggaaatcaaggctcagggaggttaagtaacttgccccaggccatgcagcaagttaatagtggcaccaagatgcamaactaggggggctgtccccacagccctgcactcagcctcgaggctgcactacccctcgaggtgagtccacagtctctgcctgtttcccggctcccactcttccactgctgggacggtgatggtccaggtaggagctgtgatgggatgcagtctgtgggcacacagagcagggacattcaacccagcctggagggatcaggtgacaatgaaccctgtaggtgagtgcacccgccagggccagcgtgctggagggggacccacctgacctgccccgggcttggcctrtaggagccaggggattttttcactgatttctgctctcatctttatcattttcattttctactttctttgtgtttagtttgctgttctttttctggcttgaaatggaaactaagatgtttcagccttttctttttattttatttatatgtatatatatattttttattatactttaagttctagggtacatgtgccatgttggtgtgctgcacccattaactcggcatttacattagttatatcttgtaatgctatccctcccccatcccctcaccccacatcagccttttctcttcctaaaaaaaacacgtgtttgtttgtttgtttttgagaaggagtctcacactgttgcctgggctggagtgcaatggcgcgatcttggctcactgcaacctctgccttccgggttcaagcgattctcctgcctcagcctcccgagtagctgggattacaggtgtcccccaccctaccaccacgcctggctaattttttgtatttttagtagagatggggtttcaccatgttgtccaggctggtctcaaactcctgacctcgtgatccacccacctcggtctcccaaagtgctgggattacaggtgtgagccaccacgcctggcctactttattttatgaaacagggtcttgctctgtcacccagactagagtgcagtggtgcaatcctagctcactgcagtctccacctcctgggctcaagccatcctcccacttcaccccctgaggagctgggagcacaggcttgccccaccacgctcagtttaaatacacatgtctagagctctgacaactccctagcagtgctgcctcgtcaacatctcatgagttttaatgtgctatcaaaagacagcagatttttatgaatttcacttcaaaatcttgtctaatttccactttgatttcttctttgatccatggmttctttagatgtrtactgcttaatttccaaacatttgggggagtttttagttatctttggttattgatttgtctttaatcgcatggttcgcagagcccaggggggatttgtaaaaagtggacagagatcgtttttcaggyactaagagccatggagtgggagacccccagcaactcccctctactccaagaactgcctcgtcctgtcctcactgacctctccttcttggggtgggggtctcrctggttcttccatagggtcctgactttggatatgttacccgggagatcccgctccctggtccctccagccttgactccttcggcaacctggacgtcagcccgcccgtcacggtgggcggcacggaataccccctgggccggatcctcatcgggagcagcttccccaagtgaggggctggggcgggaggtggggaggcacaagggaatgactgcagcatccaccctccctgtgcccccatcacaaacacaattccccagtctgagaagtgatcttaacttcctgcgtggaatcctggaatcwaagactcggcaacctaggatctcagatttaaaagatcagagaatcttaggagaaaastcacacgcttgtggcctgcratcttttggcctacctcattttatgagcttaatgagtcaccaacataaacagatatcgggagggcctcccataaaaaggcaggtttctggcttctcatgaaaaattggagaagctggggaggtgagatacagtctggcacagagacagaggaatagactcrttgacttctcccattaggaagtcagaatagcttctgtcctaaccatggcttaaaagggtcctgaggtcatgaagttcccagggcaggtggctgcaggtaagcaagtgattggccaggataccctgatgacagaggtgagtcagtggatctcaccctggacagatgtgatggagcaggaaacaaggtatttaggttttaacgctcaaacaggtggcgatgtctgttaggtcctgctgagtgggtgcacaccctccctgcaggtaaccaaagaatgacgtgtgcagttcagggtcctggtgggtccccctgtttcctccctggagatgacacccactgtaagccctggagatcaccttcctgtttgtggggtttttgcatagcaggggtgcccccacttaccccccaagccctggctgaccatctggtctccagcccagaggagtcaggcagtgctgagaaggtcacagcctcacctggtgaatctggcagcctcagagctctggatcggatgaggcgaggcttcctggcacctacccaggcaygtaactgggwgcccagacaggatgcctggggctgagactggccaggcgagaggcatgtgctcaccctgttggtgactcatgcccagacactactgtgtgggctgttctacccacacccttgggggcagacggtccttgaggcctcaggacagtctttctctaactcagggaggaacccgtgaggaaggagcacaggctttggaatcagatggacttgggtttgagtcctggccctgccacttgccagctacatgatttgggatgagtcccccaaaccagtgtataccacagtgcctggcacacaataggtactcaattaattcacttaaaaatatttattgtatgccaggcacagttaaaggtactggggatacatcagtgaacaaaacagatgcattttaaatgagcaaattattttgtactccatgcctcagtttccttatctttaaaacgggcctgatgaaaatcccagtcctagctacagaatcagcattactggggataaagaattcgtgtcaaccacctcttgaatgcttaggtatttttcatttggccccagtagtggggctgcttcaaagcaggttggaactaactggaaaaatgtattgaccagctactacctactacatgtcacacccatagtgctttccccaggctacctcatttaatttctacaacaaccctgtgagactgagaccatcattatccccactttacagataaggaagctgaggcttggaaaagttaagttacgtgcattctttcatacattcatttaccagttcagtaaatatttatggagacttcctataggccaagcccaaagtctaatgctggggatacagaaatggctgaggagcttgcccttgagatttagagtctaatgagggagacaggcaagcaatggatcagagaggggatcacatatcatcccacgtgcgttgtcctagaaggcttcctaggggcagccaacgatattgacgcttctttgcgaggccaaggtgggtggatcacctgaggccaggagtttgggaccagcctggccaacatggtgaaacctcgtctctgctaaaaatactaaaattagctgggcctgatggtgcacgcccatggtcccagctacttsggaggctgaggtaggagaattgcttgaatccaggaggcagaggttgcgctgagctaagatcaagccactgcactccagcctaggtgacagagcaatactccgtctaaacaaacaaataaatgaaggaaagaaggaagggagggagggagggaggaagggaaggaaggaaggaaggaaagaaggaaggaagggagggagggaggaagggaaggaaggaagggagggagggagggagagtgggagggaggaagggaaggaaggaaggaaggaaggaaggaaggagggaaggaaggaaggaggcaaagtagtgtggagtggaccatgttgcaggcagagggaagcgctcaggcagaagcctggaagccagagaaggtacagctcaaaggaaaagtcgaaaaaactcggtatgggtggcatgtagatgggcagggatggaccggtaggacctcaggcaggagggggctctgcgggtccagctggggacagagttcagggagaaaccattctgttcagatgcctcatggggcagttctctcctccaggatccttgggacctgggctcaggagcagagagctcagaggatgcaggctcaggggcggagagccggaggatgtaggctcaggggcagagagctcggaggatgcaggctcaggggcagagagctcagaggatgcagactcaggaaggggaggggctccttggtgttctccaaggactttgctcccttctctgtcccaggctcctgccccagtctctatatcacactgcaacacatggacatccttacctgtctgctcccacaagcctcacgagccagtgagccaagccaggaaccttctctcaagggtgcaggggtctgctctgggaactcccaggcacagagcaaggaycccacatgggaaagtgaggggtctcctgtgtggacgtgtccccattccattggctgttggactgaaaaccaggaatgaggcctttggtggatagataggacctgaggtttgaaaagggttggctacgtattaggaccacatagcaagttagcagtacggtcagaacccaggtctccttctacctgggctccaaactcaaatttagcacctcaggctgctgtccagtgaccctgccttggtttctgaccttagcaatggacaaaccagacaaccaaacattccagcagagagaaacagacaataagtgaacaaaacaaataagtacctccaatcatatgtatgaatatagtatgaatgcatgaacaaatgcatataactttaattttctgggactcaactccctcacctgtaaaatggggacagtaakagtcccaaccccacagggctgtcataaggattaaatgaggtagcctgggtaaagcatgtgtgtggcacatgtcaataaatgtttgtctcagctttgctgagagtctgctgtttaaacaaagccttgaaggaaaagaggcagttaggccaagcacagtggccctcacttgtagtcccagtgctgtgggaggcsgaggtgggggggtcgcttgaatccaggagtttaagactagcctgggtggcatggcgaaacccacctctacaaaaattacaaaaattagccgtgcgtggtggcacatacctgttgtccaagctactcaggaggctgaggtgggaggatcacttgagcacgggaggttgaggctgcagtgagccatgcactccagcctctagrctgggcaacagagtgagtgagaccttgtctcaaaaaaaaattaaaaaagagagagagaaagaaagaaaaaaagaaaggaaggaaggaagaggaagaaagagaaaagaaggaaagaaagaagaggcagttaaagatgtggctacttaggagaatattccagggtgtagaaacagctgtgcaaaggccctgaggcaagagcaggctggagacagcagatcagcagggaggctggtgggcctggagccaagtgagcaaggaggggcgcagtggggagtgaggccagagagcttggccgagcacgcttcagatgtaacttggagctggtatttctatgtatatcatagggtcatcaggaggcttaaacaagacacttactgcgaggaccctaaggacagcacacagtaggtgctcaaatgcacacacaaatgcacagtccattctctgctgtcttggcttctccacgctctacgccccacgtttaaagcgttctttgagcaattccgccccctggtggcagatctgatgatgactcaggcaaggcctgatrcctctcaggcacaaggtgactgcccgccctctccctcctggccaggtccggtgggcggcagatggccagggcagtgcggaacttcctgaaggcacagcaggtgcaggcacccgtggagctctactcggactggctctctgtgggccatgtggacgagtttctgacctttgtgcctacctctgaccaaaaggtgcgtcccctccytccctgcctgagccacctctgcccttgtctgacctgatgggatgagtcagggcaaagccatctggaaccagctcaaccctgtgccccgagtaagctctggattgggacattttytgggtcagggcaccctgacacgctcatcctcacacttccagggtatttgtgcttggacccaaatcccttatccaatagtcaggaatgatattgataataattggtaatatttattgagcacctactatgtgccagatactcacatgttttaattcatttaatcctccaacaagcccgtcaagtgggtgcaattattattgtcccattttacaagcgaggaaattgaggctcagaagggcaattaacccatccaagctcacccagcctgcaggtgtcaggataggattcaaatccgggttctgggcctctacagtaagccttgcagaggtggcttgggaaggcatggccagggagccagcagcctgggagaggaggcttcccagygaccagtggttacagctctgctagggacagctctgacagtgaaggaggagacatctgaattgggtattttgtttgttttttgtttgtttgtttttcgagacagaatcttgctctgttgcccaggctggagtgcaatagcgcgatcttggctcactacaaccttcacctgctgggttcaagcgattctcctgcctcagcctcccaagtagctgggattacaccaccatgcccagctaattttttgtattttaagtagagacagggtttcaccatgttggccaggctggtctcaaactcctgactgcaggtgatcygcccaccttggcctcccaaagtgctgggattacaggcgtgagccacsacacccagccctgaattgggycttgaaggaagaaatcagaatgccctggtgggcaaaatgcgaagggcstccagggagggagaacagcacagacaaagttctggaggtgggaacctgcttggaggactgggagagttgcagacagtgctttgtggctggggtgyagaccgagtgggagaggggagtcccaagaactgtcaggcccctcctgagtcctgagtctggggtctcctgtgtctaaggggaccctgtccactgagccattctccctccctccgtgccagggcttccggctgctcctggctagccccagcgcttgcctcaaactcttccaagagaagaaagaagagggttatggggaggcagcccagtttgatggtgagtgccaatgacccggtcacccctgggggaccctgccctttcatcaccatccttgggtacagcccctgcacctgcagatctctcagctggactcagaacccaacacccactctctgtttcttgggtccccaggtcctctgatgggtgggggagttcctgggccacaccccaggagaggaaaggcacaggaagtcatgagtgccccasgtgccggtcaatgccaggcatgttcttgttctcactcccctttgatctctctcccctcttccttatccctgttcacagaagtggaaactgaggctcagaaaggtgaattggcttggmcagggctatgcagccagggagcagcagggctggggccttgagagaggaaggaggagaagccaggcttggtcagggcccctctgcagagcttcctgcaggagctaacagaccctccaagggcttggttggcccatctcccctccttatcacagcctcagtgttctcatctggggaatacctggggaatagagcattggaatggatgtggtgcagacatccacaaggatagccctgagttcaaatcctgatcttggcatttgctggctgtggtatcaagggtgtgttctgaacctctcagtgcctcagtttcctcttctctgagttgtagatgataattaatccctcctatagttgctttaaatattaataatacattaagtaggatgcccagagcatggcagacattcaataatggtagctgtgccataattattaggctccaagtccagagtcacttcctgaggggttccttatccatcaccaggttttccttgcagccatggcttggtcccttcaggggttctcagtctctggctttctctgtcctggcttctgaccctggcactgaggtaggagggaaatcctggcctggattatgtagccccaggctgaagacggcctccaggcagtgctccctgagctatgtactgtctttctcttcttgcagggttaaaacaccaggcaaaaagaagcattaatgagatgctggcagacagacacctccagagagacaatcttcatgcacaggtgagaggcaggaccaccagctgctctaaggggtcctttcccttccagggagaagaagccccaggaactgggttgggtcagagattcagcgctggagctctcatggtcctgggggctgctggggcctgcaggtgggatagagcctctgccttcaggaacccacagtctgatggaagagacagagccatgccctcagagagctcccagcctaatgagggagacccggccccacgctggggcaatgacctattttcacagaagcaaatctgagcctctcatctgagaagtctggtgaaatgcgagagacacggtggggaaataggaccttgmggggcccagaggtggggtgggtaagattcagggggatcctgtgggaacaggtgaagcaaggtgtcaggaaggggcagggctcaccccaaggataaaaaatgcctgccccatgcaaggcgaaggggctagcacagagtcggtgctcagttaatggcaggagggcccttaccccttcccggtagtgcccagcgctttctcctaagctgctgagaagggacaggagcatcagccatgctgtggctggggctgggacagtgtgttgtgctgacaagaacatttgcatccagaaactgcctgggttcgaaccccagctttggcacatcctagccttgtgcacttsagcaggttgcctgagcctcagtttcccccggacagcaatggtttctattgcacaaagctgttgtgaggcttgaaggagctagcgggcccagagggctccacacgggcccagcgcacagtaggtgcttggccagtgttatgctcttcctagtcctgggctgcccagctgcctccttccccagaaatgcattgactggaaccgtaatgtgctgaagcgggagctgggcctggcagagagtgacatcgtggacattccccagctcttcttcctgaaaaacttctacgcggaagccttcttcccagacatggtgagagcccttgtgcagggtcctgctggggggtctgcggggctctgagaagaagcactccctggcccagggcaggctggtgcagaggctggagggccctgcggacctctccagtgtctgtttttgtgaatatagagaacattcccatcagtggctctcaaccagggcaattttgcccccaggggatttttgttgccgcagtgaggtgcatgcccctggcatctggtgggtagaagccagggatttcactaaacatcctacagagcataggatgccccgccacaaagcacttttttttttctcacccagatggaaaaagaaagcgtggtttggttccaagtgtttcaggcttctgtctctgggtctcagctgcctgctgtgttccccaccacagcccctcgcttgctgctccccagtgggggtcctgtgtcaggcggkgcaggtggggtgggcggtggcctcgctgactctcattaacagggcagctgacaaggagatgagcagatgtgatctcaactgggaagggcctgagcgatgctatcggggtgggcctggcccaagtgcccattaacctcttgggaaaggatgttggggtgttggcagctggcagrgatggtcccccgggatggggatagaccctctttcttcagactgcggtctttagcttgaatccctctcttgggacaagccgagggttggaagtgaatgtcggaatcgggatggaatcagggttggaagtgaatgtcggaatcgggatggaatcagggttggaagtgaaagtcggaatcgggatggaatcagggttggaagtgaatgtcrgaatcggsatggaatcagggttggaagtgaatgtcggaatcaggatgcaggttgcaggaggtggggagggtcagtgtgctttcctgactcctcatggggagattccagcctctaggtcctggcagagacccccaagcaggatttctcgactctgtagctctacttctgttttaggctggataagcctttgttgtagatgctgtacagtgcctcgcaggatgcttagcggcctccctggtctctacccactagatgccaatagcactctcccagatgtgacaaccaaaaatgccctagtggacaaaatggaccctgattgagaaccacggcttgaaggcagtgttgtctgttagaacattctgtgctgatgaaaatgttccatatcggtacaatacagtccagtagccactcagctaccacctgaaatgtggctagtgtcaatgaagaacagaaattgtaactttatgtaagtttaattttaatttaaacaactgcatgtggccagtggctactgtggtggacagcaaagctctaagggactgctgagctctggttctggctgaaggtggsggggagggcctaggctggagcgtgtgtgtctgtggtctggcctccatctgccrgaagcccctgactgtgggtcatcctgtggggattccctagcttcgttccaggctctgctgaaggatcccagcttgtcttcactggagggtcccatagggaacacccagttaaccccttggtttgtcatatggggaaactgaggcttagaaggagagtgggtcatgtgtctgaggtcacacagtgagcgagtggcggagttgggaccagcccccaatcccatgactcctcctttaggaggaagcagaggcctggctggctctggccctggtcctggtcctggtcctggctcttttctcctctttctgccctttgccccctgcatgccccacccccactcccaccccagcatgttctggcccattagtgggcaaagaggtagttcagggccaaggccaggggactgacctcacgggaccctccagctttatgttggtccctgccatggatgagggtggggcagacttgagggtggggggcagagcacggagagtttgagggcagagtccaggacaggctcacctcaaactcaagacagcccagagccgccctctagagagaaggtccggagtcccctttgaacaccaagggtcaccccttatgacctcttgccatcaacctgggctgagatttcctctaagaaacccccatascacagcatgggggagaattcccatccccagattagggccccaagccaggtccgcaaccaagggaaggagaggtgcccccagagttaaactcaagtgtccccaaaggctttcagccctttcccccaactcctcagtcccacaggtggccagataaaaagcatggattttggcaccagccagatccaagtccaaatgtcagtctcatcattctctggctgtatgattatgtgacttaaccygtctgagccacagcttcagagggaggctgtggcatttagtgatgatatatctggcacataaaagatgctcaataaatgctaacaatgatcagggctgccaaagacagttaagcaagctgtgcacagcaaaagcacaccacactttggaagacatccacaccacagaccttgtaggtgtgtatatttgttgtacaagtttctggcagatgacacgaaaatctcttgttctaacaaagttgctataatatgacaattttctcatagatgaaagaaagagtgggagaagtttttttttgttttttgtttttgttttttaatgtacaaaattcctggtagycctggctgttattcaacctcatttccaaccctgaatctttttctcctctgctttcataggccctaactcttgagcaaactccagtcctagagccctttctaggctgtggctatggccaacccattccccagggcctgtctcattctggcaaggaaggggtgccaraagcacagcacttayagccagacagcctccctcttgccttttctcttttgcaggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacrtgcgcaggaagccctttcccttcaaatggtggaacatggtgccctgagcctgcccccacccgccatcctctctgcbctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagatgggccccacttagaattgctcccccttcattctgatgcctccctggggaacaaggataatgactttgcatctgcacctggaacggggcctgggggaccwggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggcaggaggggatgaggtcagggtagcagagtgtgtgacgacggatttgggggcctagaggtgtccgtggttcctgggctgggattttggactctggatttgaagggagctggagcttccagatgtagcaggggtagggggccagatgttagaagagggtgtgtgtgttgggaggaaattaggttatctctgaaggtggagtttaatttcctttaatagtctttaattattccccttcattctgcaggcagtgggaggggaaggcttgcccggtctctctcagcaacccagggaccctgcacatagcttaggtttcatccctgaataaaccgctgtgcaggcccatgtcccctcccacagtagggaagacagctgccacgggaggttaatagcccggagtgaggtcactgagacatgcacaggcaggctggttcagctgggctgcagggcacgggcaggaggaagccagcctaccctcttcccccactgccagtgaggccattgtagggcagttggccctagggcttcggtccatctaggttttcagtggcccctgctgagacctcacactgagccaactactgtcactgttttaaccaacaaaagctagcctggaactgctatggttaaagtgggtgagcgggaacctgaaaatccccttctggaaggttctacagaactctatttgcaagctcctgctttaacctgagcgtcctctgctcaggatcataccccagcctgcactgagtcaagaaggagaaggaggctctgaaggggccgggggtgtgagctggggttgggactcccctgagaaagagctgtgggtaggaagggagtgagcattgcagagatagggctgggggtcggggccacactgagtgtgggaagctctggagttgctgctgggccatcgaggggccctggtgttggctctgagaatgttctgggtgaccagtcacctactttctgatcaataaaaatgtcgacatgcatttcttacagggctgtctacccagcctgtttgttgggttggggaggaggggaggaaagcggagaagactgcttccagttccatccactatgaagctgcttggctcaatttctgctgccacaggcggcccctgctcagctaggagagcctcacagtgccacggccagtgccacggccagtgccaggcaggctgattcagcaggatggctggcacattgcctcttgctctggggctgatggccctgctaagatggagatcagatcaggggagggatgggtcctgcctcttcatctcttctctcttccttcagcatcccctccatctctcagggacaacaggtcggggaggcagcccgggccctattaacagaggtgagagttccccagcagggctggttcccagggccacaggccactacagttccctttctggttttcgttttgttttgttttcttttcttttgtttgagaccgagtcttgctctgtcacccaagctggagtgcagtggtgctatcacagctcattatagccttgaattcttgtgctcaagcgatcctcccacctcagcctcctgagtagctaggaatacaggcacaggccaccatgcccagctaattgctaatttattttttacggagctggggttttgctatgttacccaggctggtctcaaactcctgggctcaagcgatcctcccatcttggcctcccaaagtgctgggattacaggtgtgagctactgtgcctggcccaattcccttccatttttgtgtctgaagcttctaagttacctggcttcagtggtctgattttggatgcctgaaatcatcaccctctcatcctacacatttgctgctgcctcaaattacaccgtttgatactcactcactttattttagcttttgttgtggagtaagagggcaaaaagttgctgcctattagtcattgacactttagtctgaattaaccacaaacctgtttctaaaagttggtattaacagaggagaagtgaaggcatgagtctccttccaaagacatatacagttctccgagaaagaggcaggtagtgggccagcaccccagggaaagcccctactttctgcatctattccccatctgtgctcacaagaaggctagggagactaaggcttcctcctgagctcgaactcttacccagggctcccaaggctgactcagccatcaagccattccacagctgaaaaaagtgaagctgtcccttgacccagaagcccagcagttctccttgaaaagaacatctttcccaaaaactgagacatgggaatgacaatctcagggtcctgttgaggcccttgaactggtgcagatgtcccagctggagatgctggggagcgggtcctggtccccatcctgtctcaggctgtcagcactgccagggagaagggaggaaacctctattcagcacctcctgagcctccgccaggcagggtgcgtcttcactattatctccgccagggccagtgattagctgcattttctacagatgaggaaaccgagtctccaagaggggggacactgacacccaaggccctatagtgggtgcacggtggagcctgcctctgaacccaagacttctctccccagagcccttgctcctgctcttccaggagcctgaatgcccctctgacttcggtttcccacctgacgactgagctttcctactctgacatgccaagctccccctggctggagagagttctcaccctcatcatttaccgctttcagaggtttttgggacctaataacagcaacaatagtaatacaataacgccaagctccataccagagctctaccaacgctggcccctgaggcctcacagcaaccatttttcagacgagaaaagtgaggcacgaacaattaagaaagttgcccggccgggcatggtggctcacgcctgtaatcccagtactttgggaggccaagtcgggtggatcaagaggtcaggagatcgagaccatcctgactaacacggtgaaaccccgcctctattaaaaatacaaaaaattagccgggagccgtggcaggcgcctgtagtcccagctactcgggaggctgaggcaggagaatggcgtgaacccgggaagtggagcttgcagtgagccgagatcacgccactgcactctagcctgggtgacagagcgaaactctgtctcaaaaaaaaaaaaaaaaagaaacttgcccaaggtcgcccatccaggaagcagctgaggcagggctgaaacccaggtctggctctaaaatccattaaaaaaaaaaagttggtgtttctcaaagggcaccaaaatgctttgggggtgcttattaaaaaatccagagggccgggtgctgtggctcatgcctgtaatcccagcactttgggaggccgaggtaggtggatcacctgaggtctggagttcaagaccagcctgaccaacatggaaaaaccccgtctctactaaaaatacaaaattagccggaagtggtggcacacgcctataatcccagctactcgggaggctgaggcaggagaattgcttgaacctgggaggcgaaggttgcggtgagccgagatcgcaccattgcattccagcctgggcaacaagagtgaaactccgtctcaaaaaaaaaaaaaaaaaatccagaggccaggctgcacccctaacctgctggatcagagtggacaacagacctgggaatccgcattttcaccagcttccccagcagagtaagaaagctccccattatagtctctgaaaatgcagaaaatggaggtgaggaagcaagaagcgtccgagatcaatatcatatatctctgcaccccctcaacagcacctgcccccaacagttcctggtgcctagccaggtacctgtggggacttgcttcccaagaaattaacttcctgggtgccggggtcgggacaacaggttcgtatacaaatactgggtcccttccagccaatcctgagctctcagctctgggaaggggctgggctttcatgactggagccaatgaattggcaccctgggctggaggggtggggccaggggcttttaaacctcatcctaaggggcctcaggggcagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtaagagtcagaggcctagtggtttgcaggcccttggtgctgatgcccttggaccttcctccctgcaggctgggcagggcttcttcagggcccactccccagccttggcctcggaacagcagccaatcagggaagcttgggtcctcctcttgctctactgagtttcctgaagaccttagccagggaatttgaagtttgggaggctgagccaggtagaagaggcttcagtgactgagctccagaccgggggcttggagggggctggtgccgcgaagagatggcacttttctatgtccaagggatgctgcaggttgggctgaggatctgtctggggcacacaagaataggaacaggcagatatccccagccccatcctgagcctatgagcctagaaacagagcatgaatcatttttaaaaaataagttaatacatagcacttaccatgtgccaggcactattctaagagcttcacaagtctcttgagttaagttttgaactttaatcttgaatttaacccttacaacaaccctgtgagctaggcttattattagcatcatctcatcagacaaatgagaaaaccgaggcagagagggcaagccattcgctcaagtcacacagttactaagtggcaaagccagggtttaaacccgcttgtggtcttactcaggagtcttatggttttagctgctctgatacttggaaaataaagatttccaacctggtttcctctagacactcaatgcccatgcattatgctcctactgtgtgccaggtcatgcctttgaggcccatggtagagggaggtaaggccttatcttctctctcttaggaagaaaagagggttagggtagggttttaagagctgggctctggggaccaccagggagctggcttcttaggcttttggggagaatccagggtcctggcttggaggtaatcaggatactgggaggggagggtgcagaactgtgggacagctctcacctctcaagtctcccagccctctcctcaggccaggtttctcaacctcagcactgctgtcacgatacctctttgtcatgggggccaccctgtgcactgtaggatggagagcagcattctgggcctctctttgctagataccagcagcacactcccgagttgtgacaaccaaaaatgtccccagacattgccaaatgtgccctggggtgggaagaaaatagcccacccattgagaacgagtctccaagactaagactcgaaaaatcagggcgaacttagtcgggagcagcgatggggttgatccagggcattggatgagagggggtgaggagctggtcatgggagggaaccaagtcgggagcagagccagcccaggaaataaatcctggtattggtgggtgggcagtaggaggaggaaggggattcagtggttcttgaaggaaggggcagccacggaggctgtgccaaggaggtaatgaggaaggaggggtatctgccacttggcaccactgcctgcctgccatggggtgactgggctgcgtgccatggggtgactcacctgcccctgctgcctcgtgcccgttgggcagatgtgtctccggtttgacctgtcccaggaagcctgggcctggctcctcccccgcagagcttccttagaggatagaggatggattggggcaataagagataaaggccatagcttcctggagtcacctgagccacactggaggtttgcagagaaggccatcggtgggacagccacagggtgggggatggaagctctgataccttcaaatgagggattcttgggccctggtggccaaaccccccaggggtgggagtggagagctcctagttcgttcattcacatattcttcaagtatttcttttgggtctagtgtgtgtaccattcagagccttgaaggatgagcacaggctctggggacacatacaggggagaacaagcagctcctcctctctgagaagccagcagaggctggacaaccttcttacaagggtgccacagaaaggactcctttctgggaaggggagcagga

SEQ ID NO: 12442 - DNA, 65402 bp, Homo sapiens
ggaataataatactgcaggcttcactgggttgctgagaggattgagttaatacatccaagtgcttaagacagtgccggtgagtactcagtgaatatgagctgttattataactcccctgggtgtccagaacagctctctgagcatggtaggtggggaaggacatggtgagggcacatagacttcctggctgattcctttggccccagcttctatttaataggcacattcgatgaggtatggcactggactcgttgcatctctggtttctaatccttccaaaaactcaggaattacttgtcctttttacagcagggagactgagccctagagaggcctgaagatcagctgggtctccagcaaggctctgcggagcaatcaggttcccttaatcctgctggcgtgatgatgagggtgaaacaggcaggtcaggcacatgaatgagggtgaagggggtgctgctgaagctgcctgctgggctctgccggagaaacccaaaccaggcagtgtccaagaccctgcaatttggtcctccagtccctggtgcatgattctaatctcaccttcaacaaagccacacactcaccagccctagatatggtgggcactctccgctgcagtcagctcattttttaaaaaccataaaccctcagcttgattgcaaatggaaattcaaattcatacacacactggtgactgagtagtgaaacgcctttccttggctcagggttggaggagagtggtatgccaagggcttattgttgcattggttctagaacctagggaactgtaaccaaacggtgatacttagttgtggggaaaggaacaggggaccagatgtctttgtcatcttattacctctgcaaaccagctggcttccttgacccccgatttagtcttatcagtccttggaaaactctccaagaaaaagaaaactgtaaaaatcatctgatcaaacagccatacatcaagcaccaattctatgccagaacctgagctggatatggggataccaagagaaataaagcaccatccctgccttcagtaagctcacattttaatatataaggcagacaaataaatgctttttaatacaattcagtttgtactacagtagaacattgagtacagtcagtgctctagtctacaagaggctgactaaaagcaagcactcagacaacatacaaagcaggggaaatttttttaatttggcatttgatttttttaaagccatgatgtaattggcacgggaaaaatcagaactttgtcagaattccatctacttaaactatctacttatagtttaatattgctttttaaaaattagttagtaagggagtggaaggcatgatagctttttcaatgctcagagctcctcaaggaaagtagctaggttcgagaataattgaggatatgaaactgacagaatttgatgaccatatgataaggaaggagttgaggataatccaaaggtttctgggctccataactgggaggctacaggaaccaccagctcacaaaggaaatacgggaggcttaagaaagaagctaataagattgctctggaagggaaatatctaagtgaagatgtccaaggatcagctggatatatgggttacctagacccagaattcccatggaccaggaagccaatagatgaatttcaggagagatgtcttggcagaagagatctgtctggaagcttcagagtgtggtagtgaaagggttgggcaaggatgagctcacccagagagtggtgaaaaggaatgggaaaaagtacaaagaattaaatgctgcaggacactatacttcagggaggggaataagtgttagtattagagactgagaaggaacacgcaagagataggagaaaaatcagtaaaacatagtgtcccagaagcccaaggaagagaaattcatccaaagtggccacagccacagagagataaaagaaaataaagataaagtacaatgtatttggcaattgaggtggtcattggtgctctcttctagagtgttccagtgtcatcctggagacagaggttgaagtaaggagtgacgggtagtagagaaaactgacatgaagacccctttgaagagaagtgactaaaagacaaaaagagatggggcagtggcttagataggtcaatagggccaagaaggcttcttggcttgttttgtggtaaagatgagcctgttcacaggtcaaagggaaatgtgttttaagaagggagggtggccaggtgcggtggatcacgcctgtaatcccagcactttgggagggcaaggtgggcagatcatgaggtcaggagttcgagaccagcctgaccaacatggagaaaccccccttctctattaaaaatacaaaattagctgggcatggtggcatgcgcctgtaatcacagctactcaggaggctgaggcaggagaatcacttgaacccgggaggcagaggttgcagcaagccgagattgcgccattgcactccagcctggacaacaaaagagtgaaactccctctcaaaaaaaaaaaaaaaaaaaagggaggatgattgatagggacagcaggtaattggtgggaagtctccagggaggctggggtggggagggggagggggagtgcaaggcaggacaaggactaaaggggttgaggggagaaggtatgggtgggtgaggagactcccctttttcaaactattttattcatttatccagtgatcactgagccgaggaagggagacggttcagtcctgagcatcttttaaattcaacagtgtgaactgaacacaaaatgaatgtgtttccccttctaatgtaccaaatcctgccgatcttctgtcaccaagtccatttccaaatctctgctgcctgcaaggccaaacagcccatctaaaggcgggaaaggcttaaaaagaaatgtactgggctgggcgcggtggctcacatctgtaagcccagcactttgggaggcagaggcaggcggatcacctgaagtcaggagctcgagaccagcctggccaacatggtgaaaccccatctctcctaaaaatacaaaaattaaccgggcgtggtgacggtcgcctgtaatcccagctactcggaagactgaggcaggagaatcgcttgaacccaggaggcggaggttgcagtgagctgagaccgcgccattgcactccagcctgggcgagaagagcaaaactccgtcttaaaaaaaatttaaaaagaaagagaagaaaagaaaagaaatgtactggaagcttgcaagccagagcagggcctgccggagaggaactaccccaagccatgaacacaaggccccctccccgcaacttctctactgagcaaggagctgcgagcaaatggatctctatagggcaggattccagcaccgctgagcggtgcaagcgccggtgagtcggcctttttctctcccctaggggcaggatatgcccaaggggcagggacaaatctagccagaaaaacaattcagtccgatgccgagacattctccaatcagctaagccagagaccggcctcgcctcaacgtacgtccgggaggcctggcgggaggtagcagcgattcccccaccgcccatgtggcaagtctgggtgaccagcagcgtcggtatgcacagcctcccagtgggtgtgggtgtgcgagaggccagagctcccaggcgcgcgcaccgcgggcgcccctctctgggtgtcggtggctatgactcttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggggtgctgtgggtaaagcgggagggcaccagtcgcggccagtagcctccacaggggaccgggttccctcgaaggttcgcgtacctcccccgcgcgctgcaagctgcagccagacacccgcgaagttccgggactctccgcacccgctagatctgccccttcccggactcggtcgtcgggagctggtcccgccgcccgcgccgccgctgccgctgccgcagccgaggcgctcggctgcagcagggcgcgggaaagggcactttggcgcggagtgagcaccgaggggaatgtggcagcgcgaagcctggcggcggcactccctcccccgcctcgggctacaacccccaccccctccttcccatccctcaacaccctccagcccccacctgcaccctcctgcaaggaatgcgcgggacccccaccgtgggcacgcgtccacctgaaccccctcctagctccgagcgccgagggaggggtagcatttgaggagggggatggcggccgcagtctgcagtcggttccagagggggcaccggtttcaattggagaaaatgggcgggggcagggaagggcagaccttgcagacgcagaaatggggagggggcgcacggttcctctccagcccccaggaccagcgtgcctggcagaatcaggagccgggggagtagggctcccggaaagtttatcgggaaaaagcctagcaccgtgggggctgggaggctggagaaactgaagccacagaccaggtgccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgctgggggtggaggcgcagctaaggataaaatattggggggcgggggttcctcttcagcgccacctccacctccagataaaccacaaattacatctaaagggttgtttatccgtgtttgttttgcaattgaccagtttcttttaagttcagtcctcctgttttcatttataacatcacccattaatacacccccctctccacacacacacacacaaacacacacacacacacacagtgacagagacacacgcactcacacacacaggcacatacacgcacacctcttccacgtttggaaattggaatcctgtctgggaaaaggtaaccaaagaaggacgcgttccccaagtcttggctcttaccagctgatcttgggtggtggctttgaacttgccatctagggccgggggcgatgcttatgagcctcattcacaatagcctcctaccccatcccaggagaggggcgtgtgtgcgtagacagaggcagggttaagaattggagggcggtggaggggggttgtgtgtggggtggggaggggggggaaccggttcatttgacccagtgcggtcccactcctaccctaagacaaaaatctcagggtggcagaggcggtccctgtgtgcacgcgagttgggggtggggagtgaggttggtggaaggacggtgcaagagttactagtacaatttatccccaaatttaaataatcggatcctacttcttcrtctccccttcctcctcccagccaaggccccaaaccaagagagttcttcccaaggacgtgagctgctccccacctctccccagtagcggctgcctctaggccccaagggcttagtgtcggtccccaccccatcccccacccgactcggtcgccgtctctgtctcgtctactccaggcttctccgccagtcacgatggctccttcgctgtctacgccaaactctcggcgagagggaagagacgcttcatggggggaggctggaggaaactgggaggggcaaggtccagagaggaggctyctgctggcgcgtgcagtggaaaggcacctgcgatgggcacccccgccccctttgccgacacaccccagagaagctgtgctccgggcttagggcagcctgatttggccaaaacggagcgttggcatctgtgtggccaagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcccggtggccctgggcgggcgaatctcctcagaatcgcgggcctggtccccacccccaacacgcttgtatgcccgcccctcccgacgccgccttgctgggtgccaagaaccaaccgaagcagccagaactcctcagtgaaaggcctgctttatgttccckgggcagtgaggagggggcttctcccttcccattgtccagactcagcccccgaaagagagggctcagccttcccaccagccctggagaggaggaagggactgactacgccagcagtgagtggtggtggtggccttgggggctgttagctgggcttgcctgggggtgggctcctggcttctaagctccgactttacccctctcttggaggcggggttctcctccagagaaaggaactggcagagatgcccaggcctcctgtgcagcccacagctgggcagaagagagtctgggctgctctgtaattctggggctgcagkccaatgggctttctcttaccctcttctcagctccagaactttgctctgtggctgcaacgggcagatgagatttacccccagaactttcccgggcaaaaggagcgtttgtcatccttctccctgggggctgtggagggcagggcacctattttatccctgcaaaaggcccagttactcacatcctccgccattcctgctctctgatctatttgggtccacgtgctttcactgagcgcctcctgtgctcgggggccctgagcgaggctgtgctctgggccctgcagagatgcacagtgtgtggtcctgctttgggaggatgcaggccagaggtggaaacccacacgtaactgataccgtcagacagcgataatcaccatgactgaagaaccggcatgctaccgagaggcatgtcaagacagtgagcttttcctggacttgggggatcagaaggctaatttaagaaggaaagtaggatttggtctggaacctgagacatggataaagaccttgaaaagatgaagattcatttactcaacaaatatttattgagcatcattatgtgcctgggtgctgtgctagacaatgaatatacacctagtgcacagtccctgacttgatgaaggcagaaaatatgtatacaaatacacataaagttactaattaaggatgctacaaaaggaaagtttatggtgctaggagaaacaatatggggatgtgctttaaggagatggtctgagaaggcctctctgagatggcaacggtggaagatgggatctaaaattaagcaagatgctcaggaggctaaagccagaggatcatttgagcccagctgttcaaggctgcagtgagccatgatcacaccactgcactccagcctgggtgacagagccagactatctgtctatgaattaattaattaattaattaatataataatagaattaagcaaggcagccatgcaaagttggggaaagagcttttggtatagtgagcacaggcaaggctgtaaaaaggaaagggggccaggaggaggaggatggggctggatccaggtaagcaatgggagatagggagtggggcagatcacatagggtctattaggggatggcgaggagtttgcattttattcttagccagtgagaaatagaaggtgtattaatttgctaggactgctgccacaacaaagtaccatagaccctgtggcttaaaaaacagaaatgtattgcctcacaattctggaggctggaagtccaagatcaagaggtcgacacagttggttccctcygaggcttctctctctggcttgtagatggctgccttcttctccctgtgtcctcacatgtgttcccatggtacatatctgtgtccaaacttctaatcaggacaccagtcatactggattaaggcccaacccaatgacctcattttgacttaactgactttttaaagactctacctccaaataaggtcacatcctgaagtactaggggttcggacttcaacctatgaatttgggtgggggggcacacaattcattctataacaggaggagatgacttttcagatggagggaggagagagatgcttgacagtcagaaaatatatgtaaagagatatctgtttacatttattttctgtgtatagcatggctcctttagtgaaaagtagacagctctgaatatgaaaggtaggttttcatttctgggaaagagacgccaagtgatgtggcctgacatatactctaacttctctgtgaggaaagggtaagaaaggaaagggtaccacttagaagactactgcaatagtctgagccaggaaacatgggggcaaaggcagagatggggaccctggaaacatctgcagggcartggagaggcaggagtcaaagacataacagcctacccgcatctagcctaggagagtgtgggtctcagcccagccccaagtgctggctccctgcctgcccctctyattctccctrtgagcaacaggcagtcgtgggttgaggtgtctttacaatatcacattgcaaaaaagcccaatgcagtctagtgactagccaagataagcctaatatccagataaaatcagagtttgatttagaaagaatacaaggcctgatgctctggagaactctgcctcattcaaggaggagctgtagacttgatgccctgaaattttcattctgacccaggaaaagatcaaaaagccttctgaagctgagagagagagagagagagagagagagagagagagagagagcaaatgggagattctagcaatgcgagggcagaaatagaggccaaggggcaggcagggctgcagagaagggctacaggacaaagatgggctcagaggaaaagcttaggatcccaaatggggcacaattttaaaatcatgagcatgatcaggccaaagcgagtatctcccaagggcgaggctatcaccatagaggtggcagtgatctgctgcccaaggagtggcgacagaggggcttcatgaggaaaaagcccagaccacaccaaggtgaggctgtgggcttctgaaaccaggagggagaagtgagaaggggcccacagcctaggccattcctctagtgctaccacatgctgtggtcaccaaattctgacattcttggtgaaaattcttcatttgtgtataaggaaaaagagttcatgccagtgacaaaacagggtgttaagccattgaaatattggagtttgttacagcagctagcaatacttttatgcaggcttgctcattttttgcatagtatcttgtgtagtcattcacttactcttcacttactctttcattcatttgttcatgccacactgagctgcatgtcagagtctgtgctaggtgttgaggaaacaaatataaagaagaataagacattcccatggcccctgtcctcagggggttgagagtttattgagaacagcgttaaacagcaaagcatgattgattactccagaagagatatagcatgtgatggaaataagaagggctcctagctcagcctatgggaaagggcaggtgagaaccagcactttctaggaagaaagcacagagtgggccasctcagggagggaggacacagtgtgtaaatctgcagcactcacagggtaccaaggaagggtgtggggtggaaatagacctctcttctgactcaacagtctctccataattgctggctttcttatttgtccctgctggtggatgggcaactctaggatggaaacctcttttctcccaagtcccagggtctgtattgtatctggcattctctctcctcagatgtctcataggagccccaccccaccccttccaccacagcctgctcagacctgggcttatccacttctagttctccaccccagcctgcctctctgctcagctccccaattcagggaacagtttccacatccacccagatcctgagccagaaacctatttatcctggactcccatcttgcccagtccccacatcaagccatcactgagccctccagattctgcctcctagacacctcccagattctaaccagagtccacaatggctatgtttcaggttacttacaacaactgagtaacaagtgcccatctctgctcttgccctattcaatgcatcttcctctctgccaccagctatctttttaaaacactcacctgatttcacagctcctctgtcttccccggactttcccctatggcctacagagtaaaatccaagctccctgctagaccctccctacaagagcccccatcatctgtccctgccagcccctctagcctcagatctccctattcccaaatccctcagctctaagccattctgacacccttgcactcttgcaatgagccatgctttctctcccctttcccctggatccttctgtgttttgttctctctgcctagaaagcttcccttctccttctgtgactagccttctcctatttgcccttcaaaattcagtccaggtgacagttcttacaagcagtatttgtcagtgccattcagagtgcctggtacatggtgaacattcagggaatttttgctggatgaatggataaacagatggatggatggatggatdaatggatggttaagtaggtgctcagtamtgtttgtggaatggacccaaaggtatctcttctagacttcattatttgagttccttaaagaaatgcctccactgagttatgatttaatgttatgctgtcttcagagaaccctgatgcgagaaactgacgaacctaacagcatctctgtcttttatgaaaacagaattgcatatattgcccactatgtcactcagtgtcctttatacaaggactcatgataaattcatgcttggggttatttcctggaaacattttgtctctgcagatgaagatgtgtattttctgctgtcagaaaacaaaaactctgccacccgacgtgtttccatttttgctttagctgacaaataaggatacccagttttattgccttattacctccatgaggcctgaccagttcgggtgctggaaagtagcaactgtttctgttttccttagagtcagttcttcctttattctttgatgctgtagtttgtactttttaatctgaaagctgcctcaaatcatctcagcagtaaggtagaagaagtcttaagtgaatgcattttagtgaccaatgtcccggcatggaagctatggaaggaagggcaaaatataaagcttctagctgaagggtttcccataaagggcctcgccaggaatccttggcatacctatcactactggggtctggcagaaaaaccaaagcaggaggaaagccagctgaattctgactttgttkctacctcactggaccactactgcyaccaccatattcttttattctgtcatctaggaccttccttttccctaactttaagtggagatctcataggctgccatttttacattgctaggctctcaataacaatagctagtgataatcataattacacatttctttttattgagagtttaccataagccaggcactgtgttgagaagttcacgtgcatttccatatttaaaccttcttcctaccccaaacctattgtttttacaactttgcagatgaagaaatgtcagagaagttaagtatatacaaagccacctttatcaagtagtagagtaggaattccaattcaagtgtgtcagctgccaccacccgagctcttaactgcctcctctcatgtgggcaaggaacaaggcaatagtaagggaaaaacccccaagaaatggcagagatcaccgatggtgttgccaggagagagaagccacagagtcacagctttgcttgcagaatattcaaggttccttttcaaagtcctagaaatggctggctgctctgcagccctgtcctgttgctgagacaacatgagggggaggcccattcccatgaaacatggctgcaacctcctcttcctttagctgtgatggttaattccccaagatatttgcctgggatactcctatgcatggatcctgcctctgggcagtttgacccattgagcattattcgcatgggaatgggggtccctctgggttttagggacctacaaaagcgtttgagtcctaaatattttatgattagtcccacaatacaaagaagaaaactgccacatggaaatcagtaaatatttaattaaatgcagagtataacattatgtcaacttcattaactgttggatttagtagtcataaaaatttcattgcatttggtaacaatttgtaggttggagttttctcactgcacaagatttctcgagtaggcactaagattggtgagaaatcacagcccatcacaaattaaataaattactcatggccaaaaactttcaaaagcaaaatggcaaaaatcctttcaattttcctctatagccaaaaagttatttttatggtgagaggtgggtgtgtttaaaatatgttagatgaggaacctaaaaggacctacaagagtaagcagccttaggggctatatgatgattgtaaaagagcctaggccattcccacgtttctgagttttccagcctagccatgtttgtgtcagagatgaaagccagatgagaagaggctttgactggatgggaggtaaggagaattgcctcctccttaggccttcctggttccacagagaaaagctaagaatcccagaattctaaataatgatagccaacattcactggatacatacattagccaagctattataagcactttacatgtattatttcattatcgtaaaacaagtctatgaggtcagtattttattgtctctgtttcatagatgagcaaatggagacattgaggttaaaccaacctgcccagggtaatgtaagtagtcagggggaattcaagaagttttccaagctaaaaataatttacagattaaatggtgtccatgaccattaaatgcttcactttaaactctaaaaaagacagagaccaaactcctcttcttcactactctatcttcagcacctcaaacagtgctgggcatagatacatgtgttggaggaacataactccatgttggatggaaactggaataagtcagtttatatcacactgctctgcaccaggcacttatggaatgctttgccccgcctctgtcactaggtgattctgtctagggtagacatctttttcatcatctctaatccctgtgtctttcacaattttgacccatgatggatgctcaaaaatgaacaaagcctggaaaggcgtaagtgattatgtgaattcgtttctccatcacagaacaacttccccagtacaacacaattctccctctctacacaaaacacaaaagctgctattcagaaactccaaaggcatgcatttcagtgtaatcaacaagcaaacaactgtataacacgtttatctgycagttgttgttcaagggactttccatgtgttaagcaattggttagtaatagaacatctgtagtaattctacaaagcaagtattcttcattatcatcccattttacagactaagaaatcaaatgttgtgggctgaattatatgctgcaatcctaaaccaaatacctcagatgtgactgtatttggagatgagtcctttaaagaggtagctaagattaaaaaaaagaaaaaagccattagggtgtgtcctaatctaatatgactggtgtcctttaaaggagtgattargacagggacacatatacagggaagaccatgtgaggacatagggagaacacagccaagtgcaagccagcgagagagacttcagagtgaaactaacaatgccaacatcttggtcttggccttctaacctctagaatggcaaggaaataaaattctgttgtttaagccacacagtctgtggacttcgttatggtagccctaccaaactaatacaccaaggcacagagtaacttgcctaagcttacattgccagaaaacgtgaactcagaatctgaacccagggactctggttcccgagaatatgtatttaatgataagaaatgttctctgtgctgtccaatatggtagccactagccatatgtggctactgagcacataatatgtggctaatgcaaatgaggagctgaatttttcatttaatttatataaaaataaagttaaaattaaaacaaccccatgtggctagtggctaccatatggacatagctttatactatttctaagtacatcacttaagatttttgcagaattttctagaaatctcgtctgtgcactctaaaaacatgctctatctttgttccgtatccctgctgtatttgattttwttttwttttttttgcagtcctttctgatttagcccccgttgcctggtctcctgctgagggggagagggaacaggaagagtgagtgagctggctaacttccagaatcctggggcctgggcagtgcagggtcgttggcgttctgctctaagcttaaggtgttagccaaccaaatgccaagcagcacaaacactgagtgacattttcagaactattaatatttcatcagaaatgatcacttttcctttaaatacactattttaaaaggttttctacattcttaactataattttattcagtctaggccctcagaattttccccaaaggaacacatcttcaattttgtaatgaaaatcaaaggagaatgaagctcagatttcaaaatttagagtaaacatttccaggaactcagcccctctgtaaagagcaaggttgcgtattgggcacctactgtataccaggcactttacatacagtataccattaattcatccaacacatattttttgagtgcctactatgtgccagaaacatgatcctcataatttattaacaccattttacagaaaaggaattcctctcatccttctcaaatttttctcctcaaagaagtcggcctggaccaccatggaatattgcctcccctcttctccccagtgcctcactttgttactaggttgggcaccaacctaatagttattttccatcagagtcccattgcatctgtaattattgctgctttactcgcttggctggtttgcatcgatctctcctcgctagtatacaggctccaggagagcagggaccatgccatttttgcccacccttatgcttcttcagtgcccagcaactcatcgggcacagaggaggggttgcatcagtamtgggggaattatgaatggggatgggagaagttcagaaagttcttaaggtcacacagctcggaaatgagtgtcaggattcaacccagccctgcatttatagactgccatcttcctctatttgtgtccattcttctttcttccgtctccaccctcttgcttttccttttcaggggaattgctagagaagcaaccccctgactctcggaaccagaaagtctccctcagcagaggtactgtgtcagtgcccaattgaatgaagccgcttcagtgagggtaggggcctgttgatcagcaaacagctaacttagcccttctccctgcacctcggacctcctactcctgctcctacccacctactgaagctgtctcagtggtcaagggctagatcaggcctagagtgctggggtctgagtctcagcttcccttttctcagggggccttggacgcaatcccttatgactttgagattsgctttcctcccgtgtagaacgataataaaaagtggtactaatttcacgagctttaataggattgaatgtgagcccagcgcttggcacagggcaagcgccccataaaatggcagttaggattaaaatcgaggttgccgggggacccccaggcaggagctgagatttgtgtggagcggcgaagtggggcggcggcgcgtttggctttgacttctgatcccccgaagcgctctggggtcctttgggccccacccccacccaccccaccggcgggtcttgggctccgaacccagggcgccccgcgcaccgagccgttgcgtttgaaacccacagaaagaattcccccgctcgacgacggcgagggtgtgggagctactggcaggcaaattggtgggagccgcccggcccagcctgccttgccgagtcagcgcgctcttgagccgctgggcccttcccggtgcccgcctggcagcgcggcgcgrctggggcaggggtctgctgggggccggggactaagggctgtgggcccatccacacacgcctcatcccttctttccgkgggcagcagagcagcagcgggagaccgggagcaggaggggtagggcgagagaaaagcaggacctgggccgggggtgggagtcgggccgttgacgctcgctctgcgaggggctccctgggaacgcccaggcgagcgcctcctgcggggccccgccccccgagtgcctacaatggtgccaggcccgcacccagtcctccgcgtggcttagcgggacagcatgggctgagcccaggcgccgaaagttgtcacggcggcgtcgcaagggggcagtgccagggactgtggggagagccagccctccccttccagctgttcccagatgtcattctgsccgcccaggcgcctggttcctgagctccgcagcattccactgttcctaagctactggtttttgttgacttttaaatattttcttctaagggagagggggagggaggcaaaagtcaggaaagagcaaataaaaacaaatcaaaataagccctcccctccccaaaagaaagctgtcctccacccacccctcccacacaaatagaaggcctctgaacctaaccaccttgctggagcgaaagccagacagaactgacccacttctgccaagccccatcctcatctccctttctggtgaatgaggggtggtggtggttgtgttctagccctgggtggacagaggggcttccagaaagagaggaggaggatggccagcgggaatgggcttccttcatcctcggccctggtggccaagggcccctgcgccctgggcccattccccagatacatctggatccaccaggacacaccccaagacagcctagacaagacttgccatgaaatctggaagagagttcaaggcctgcctgaggcctcacagccctggacctccatggagcagctctctgtccctgtggttggaactctaagaggcaatgagctcagctttcaagaagagtaagtacccccctactccattggcagcaagggaggagggaggagatgaagtctgaccttctgggggaatgttctggcccactgttgaggctggtgaaaccctaaaggctgtatattgccccctccrtggtcctttgtccaagctttatagaagagctgaccaaagttctgaagttttgtgggtgaagagtcagattagggctatattccaggctgcctcttcaccagcccgttaagcagacatttctcatcctaaacgcatgtgaatctgaggtccttgaaaaaccaccctagctaaggctaagggttatatggcttgtggctttccccagaagcaactagaagatccttcccctctcccacctaaaggctaggcattcacatggatgagtctgatggttttaaatcacatctggaattccctaatacagggagcagctgtcccattcagcctccacagaagctgctgcaagagcacacatcaaaatatttactgggaaggcactgacatattcagaggacataatagaaaattaaagtgcgggaagatggctgtaaatagcccgtttccgggatgggaaatcctgtgtctgggaaacacagagctaagtgtttctccatcagggcaaagttgggcagatattgttgaggatggatattcgaaaggaaaggaaggagcagagaggaaaaagggaaattaggaaaagaaagtaaatctgctgtggttattaataccgccgttgagcacttacttatttcacgttttgcatcttcaaagtggactgtaaacttaattaatgttcccagagtccctgtgaggcaggtattagtgtccccattttacagatggattaagtgttaataattaagagctaattaaagactaaccgataattaagtgttgcctgctccaacacatgctacagctcagttcagagatgctctggagttggggagccattcaggcatttatcagctgcctcgggtttcagggatgcctaagcaagagctaagaagaaaagcaaagtgtaaatgacacccagctctacactacctgctgtccctctgtgggctcatttacttactgcagatgaaggtggaaggcactttggctagtcctgcctccctgccctgtgctcagcatgacaaggctcagacaggaatggcccatctacagctaaaatcctgctgtcaggcccttcagtggcactgagcccttctcccctgctcattgccatctgctctgggacagggccttggcaggagggcccatggggctgtgctctgctctcaatggccaagaagctgattgtccactttgtggaccaagggtcagtagcaatttccagtagatggcatcctctttgccaggtcacacagagttaatggagacagactygacttccagtctgcacttggctgaaaattgaactggtgcacctttggccagctgcttaactccatttggcctttacttcctcatttgcaaattgagggtgatatgtgctgccttgtctacctcagagttgataatgaggatccaatgtgatgggagacagggaaatgaaagatgcattatacaaatcaggctgctcttaacatgtacttcttcaggttgggatttgttgttgttgttgttgtttttgttgttgttggcttcaatctggggttcacactatgctccatatacctcaaggtgcttcaggggtcactgtggagtcaagtgggctggttgctgggccccaaaatccatttcagccagagctgtttagcttttatcagttttacttactagagttctgagtagggctgaatttgaaaaacatgtttctgctattgagaaaagagataggaaaccaatgacttagacgaataaacgacatcctaattgtcaaccaaatagaacacaatkagctattcttaaaataaaggcggtgtgctggtggagtcagataactctggtttcagattccatttcagccccatgccatttgaagaatttgttactctttaatttatctaaactttggtttcctcatctgccaaatggagattaatactatacattttgtagggttgttggaatgattaaatgggatatttaaacatttatggtaataattcagatttgtaaaaattccttgcaattcagatgtgatcatttctttaagctctacaattattgcatgaggtaggtactcttttaaactttccatctctttttactttttattatgcaaattttcaaacacatagaataataatatggtgaatatctatgtgtctatcactgagtttcaataattatcacattgtgccattctggtttcaattgctacctccacccctccatttataagtgaaattacttttacagataacgtggctgaggtttggaggggttaatttctttgcccaagctcctacagttaggaagtagtagagtttcagaaatgaaacccaagaccgccttggccctgaggcaataatgtcggctgtcctgtcttagaatctggggcatctttgaatagtcaaaatagttgggagtcccatatactgaatgatcacacacagagtgaaaagccagggagctgttcttactatttctagaatgccttcaggtgcacaagatatctctcagctggtctttctgctgcttaatttgtagacctggttttggtggtgttttcttgtattgtggtagataggtaagtgcattctacaattctttttggccagaatttgtttttcttgactctgcacctatttatcataggaacctagacatttcaaatttgaaagagatttttgaagccatcttccgctgctcgaatcccctccttactgtccctgccaagtggtgcacttgtaccacttggtacagtttmtcagatggggagcttaccacttccctttgctgccccttcccttgctatgaaccccctcaaaataccttttgctttctatcactgaaatatgtctctatcaaactaattcccattgatctggattctgcccttagtactccaagccaaatctatgtcttttttctttcgatacccctttggatagtgaaagacagcaagacagcaacaatattcctcccagaatgtttttgtctctataagctaaccacctctggttttctaagtttctccccatgtgccaatttggttagtttcctgtccacactgttggtccttgtggcagtgtaactttgaaagccaagtacaataatccaggggtgatccaatccatgcagatttgatcctccctgtctgcattctgtttcctgttaatgacaaccaatactacactcacttttttccccaagtcgactttcactctgtggacacattttcaatctcttaattcattcattcaattattcattcaacagatatttattaaacatctactatatgctagaactgtgtgagaaactagggggatggagctgtgaactccattaatccctgccttcctagagctcacattctagtataggagaaaaaagaagcaagtaaatacaaaagctatgatatcttcagaatgtgaaaagaatggtattcccagtggaggagacccataagaaacacacaaaaataaacaagataatttcagtgacaactgtgataatggaaatagagcagagggaagtgataggaagagctcctttagtctgggtgtcaaggaaggcttctctgaggagatgtgattatctgggctgagacctgggttctaagaaggagccagtcaagggaagttctggaaagaacatttgggcaaaatggagarcaagggccaggcatggtggctaaagcctgcaatcccaacactttgggaggctgaggtgggcagaacgcttgagcccaggagttcaagaccagcctgggcaacatggcaagacctcatctctacaaaaaatacaaaaattagctgggcatggtggcacacacctgtagttctagctactcgggagggtgaagcgaaaggaacacttgagctcaggaaagtcgaggctgcaatgagccaagattgcactactgcactccagcctgggcgacagagtgagaccctgtctcaaaacaaaaccaaaaggaaaagcaaatgcaaagactgtgaggtgggagtgagctttgagagggacagcgagacgggagagtcaggagggatggggacatggccatggtataagtataacagagacaggcaggcaaggcctcaggaggcctggaggatcactgcggggagttcagattttattccacatgttatggaacacttttgcaggtttttaggaaggggtgtgacatgaacagattcactaatgttygaatctctgtccagcttctgtgtggagatggtttgtaagtrtgtgggagaggaagtgggaggcctctgggaagatactgtcagagtccaggggaggcctaatggtggcagtggctgggtaggagtgactgcagtagggatggaaaaagtggaggattcaactgtgtgttttaagatgagccaatggacctactcatgatttgggtacacaaacagacacattgaggctcatgctctgcttcacgcacgagttcacttgacaaacaaggatgggggcatgcatcactatcaatgtgactggggtgttgagaccgaacactggcaaactcaagrtggggagtgtagggcctcagagcaaaggattccaacctgtggcccatggggtctctgaagtaattccccaaatgctgagagctgggaggatgtctttccggcaaaagggtgtagagaagctttcctcagattttcaaagaggtgttgacccctccaagaggagaaaacactagccaagagcattagactccaaagatctccagagctggtttctagtctaagacatcagcctgagttccatgtctgagtcttgtctttatcactcccatcaccaagtttcaagctttcaaaataataatgataataaaagaggctatgtattccaagcttgagcccctggttggacggtgtgccatttacaaaggtggggaagaaatggggagcaatgggttttgggggagaaatcaatagttctgtctagtgctgatttaactccaaaatckggttcagttatcttttagttagtcttaagtttgggcttagagaattgtggcaagccacttattcaaggattacttattcattcattcccctaatctctaaaacttcaaagcctcagaatgaggtctttggatttgctgttgactccgttgccctaactacagaatgacatttgttcatttcttcattcatgaattcattcaacaaacacaattgccttcgcagtaccaggctgtatgatgggtcccagggacacagagataagcagaacagaagcctttcctcaaagagctcccagtctagtgggtgrcatgaacacagatacatctgacaacaatgacattcaacaaatattgccaggtgcggtggcttatgcctataatcccagcactttgggaggccgaggtgggtggatcacttgaggtcaggagttttgagatcagcctggctaacatggtaaaaccctgtctctactaaaaatacaaaaatcagctgagcgtggtggcaggtgcctataatcccagctactcaggaggctgaggcagaagaattgattgaacccaggaggcagaggttgcagtgagccgagattgtgccattgcactccagtctgggtaacaagagcaaaactccgtctcaaaaaaaaaaaaaaattagtatgcacctattactgaaatgtctgaaaaaaatacaatggtggaaaagctggggacagtctctgacctcctttatgaactttcaacatcttgcaaaaggcagatcacaacacactatagtaagtgttctggtgatgaagtgccagtgccatggaagcgcactgaggggacacatgactgaacattgtacttgactactggactgggcttggtacttagggaagtcttcctctgagggaagcaatctgaagcagcaacagatgagacccctgcactgtgtgatgaaagatgcgggtgtagtccgcaggtagcagggatgtcatgattaataactgcaaaggtttccatagttatgtcccccagctaggtcttgagaagagagaaagaacagcctatggaaagagcccagcagcaggcgcagggaaagatgagaagttacatgggagtgaagtgtagcatgtgttagtgaccgggagaaggtggctcgagcttgctgggtgtggttggcttccctggatgcttccaggccctctgtcagcacccaagactttcccatttacctgtcataacaaacttggtctgcagagtggaaaggctttggtgagcattattccaagccagactcaggtagggagataaatctactgaaataaaagaaatctgtttaagcattttttgaaaaacagaagtggtttattgattggcagctttctgaggctatttgttgcaagaaggaagaaggcttttttgcacttattttggtaaactttcactgttggcttccattggccagttctccacactggtgagcaagtgatatttgggaatccactcggcttccttgcttgaatggctctcccaacaaacatctctttgtgctactgttatttaaacaattaggtgaacccgacttctctggaaaagttgcttggaatacatagcctcttttgttttttttggttttttttttagcattattctttaaaaagcttgaaacctggtgatgggagtgataaagacaagactcagatacggaaactcaggctgatgtctcagactagaagccagctctgaagatctttggagtctaatctcaactagtgttttctcctcttggaggggtcaatacctctttgaaaatctgagaaaaagcttctgtgcagcttttgtctgaaacacatcctcacatctctcagtatttgggaatgatttcagagaccccgtgggccacaagttggaaccctttgctctgagacccaacccttaagcaagtgtctccctctctctttattttactttatttttaaatttatttttattttttagatggagtctcgctctgtcacccaggctggagtgcagtggcgcgatcttggctcactgcaacctccacctcccgggttcaagcaattctcctgcctcagcctcccaagtagctgagattacaggcatgcacctccatgcctggctaatttttgtatttttagtagagacagggtttcaccatattagtcagtctggtctcggactcctgatctcaggtgatccacctggcttggcctctcaaagtgctgggattataggcgtgagcccttgcacccagcmtttccctctcttgagcttcccaatgctgggtctcagcaccccagtcccattgacactgatgcacccctgttcttgtttgtcaagtgagctagtgctggcagacactggctcttccctcctccagcctgccacacgtcctggcagtcccccttcatgatggcctttggtgccttgcctccctgctcgtctctcctctgccaccctcaccacatctcttctcactgcattgggtgcctttccctccaggatgccctccacccttcaccaatttcatcttctgaagcaggtcaacagcactgctcagacatctctcatggctcgccttgtcctctggccccttgggcctggttttcaggggtctctgtagtggccctgcctccatctctagatgcacgtcttgctggtctcctgcacatgctctrtaaaccaacaagagctaccagcaggtgcatgtcaccttgcctttgctcatgttattccactaccaggaatgcccttctcccatatctctgtctatctaaatcttatccatccttaaggacctagaataagtgtgttgtcctctgaattctttgttgctcacatcattcaacatttttctttctctttttcccacattcctctttttaattgamataaacaactatgtcccacctctttcctaagtgttttaaggtggcccagataacaaaaaataaggagacaggtggattagagttccagcacactttctagctgtaagcaagttccccaaactttctgtgccctattttcctcatctgaaaaaatgggaaaagtcacagcgactatttcaagggattactatggaagcaaatgaaatgatatatgtagagctcacacagcactgggaataagagaaggactcgatgttcatcatcatcatcaccattccaccatcatcattgtcattatcatggataaaataacaggacatgattgatatgggacaaggagatatatatgccaggaaacttaggctgaagggaaactgctcaactgataacagcatctggtttgagattcttggcagccagggcataaagggagatcatagcattcggttttcataactcatattgtcttctaagagaaagcagaaggggtcatcataagagacaaatgcttccccagctctgagagctacatgggatagatcttttgaggacgatagaatggaagaatctgtttaaaatcagctctcttcttgaccattggccagagggaaggacacagccccttaatcggggctatcagcccagttccagtgtgggattctgatgaggtggtgggcacctggcacatatcgtgtgctgccttgtggcaacaattcctcttccgctactgcactatgggcttcttaagggcaaggtctgtgtcttactcatctttgtctccccagtgcccagctgagttcctggcacttggtggctatgcagtgggtatgaataaataaggaagtgaatggtgaataagccataaaactgccaccacccagaggtagccaggatcgaagcaaggggtcacggtcatcagaggaagcacagaatatcaatagctcaagacattgcaggttttttcctccttctgtcttaggctgcagaaaacagaactaacattttcttgagtactttataggtgccaggctctatattttcattttctgctttatttcactatcttagcaacccttcccagtaaaaggtcaatattactcccattttatagatgagaaaggtgaggctcagagaggttaagcaagttgcccaaggtcatccagctcagaggaagcagagcacggataagagtttgatgtggcttcaaggcttgagttctacccggaaccatgggcccttccgaatagcccttccacgtctgcttagtaccaggagccatgagtggtgaagaaagatgaatcatgattaacgtcccacttcccatgtccccmtttgtaatttaattttatggtttcgggagctgtgtcgcaggttgtgggagcctgcagagatgggccaccagtggtttggtttaatcccctttttaatatctttgttgcaacgttatttccaattcagctcccaagtcacattaaaaaaaaaaaacacctcttccttagggtaagccttcccttattaaacagattcaaatgaaaagttttaaagacaatttgaacaataagcatcactctgtagctcccagctgaagactctttattgctgtatttattccctggtatttcctgtctcattccccagctcactgaatccacccagtcccccccccgccgccccccaccacccaacacttctagttcttgcccaactcacctgttccctggagggagaatcaggtggaggacattgtgggaagcagggtatctcacttccacctgacaatatgccatctaaggctgtctcacctgccctaatgagcaggaaattattgcaaagcatctagagggacattctcacctggctgggtgtctgcaagtgcaccattgcatcaaaaccagggtgaagaaatgggatgcgagattctggggaaaacggggatgccacaagtggagaaagaatagctgctgaaaatgcagacacctgggccccattctagatcagctgaattgctatttctccaagggtgctgaggaatctgtatttgaaaccagcactacaggtgactcatgcatgtgtgtgaaaggttctctgatactttggaagggggycaaagatgacaaaaccttaggcttaaaagataactgtctggtacatctttgagaaggaggtgtttcaaagaaaagtgtggaaggaaggaaggagattgacctttattgagttctaagtgtatgccagggacaattaaaaaaatttgaatctactatgtgtgaagacctttggtaagaaattagatgaacataaagtccaggcttggcattcagggagctgagagatttcacggtgttgccttctttaagtctgagtatcaccatccccactttgcagatgaagagaccgaggtctccgtgattcccctaattgtatagctttagtaaaccaggctcatggctgtgaatctgggccagcaggactccaaagcctgcagccaggcttggctctcccacaccaggctgtctcagtcagagctgctaacatttgcatagcgctcgttacaatttaccgagtgctttcacattcatcatctcacttaatcctcactgcggcccggagggtggaggagggctgggggtggggaggccaaagctttctccagccctaagcttagtcccctgmctcctatcaggaaagtcccaggagacagagcttaagggttttccaggtacctttgggacacgggttcacaagccctggtaccgcaactgaatgaatctgcaatttctctcaattgtcccttatccctaagctgaaggaagtcagcctaggccccccagatagtgagagaggtagaatccaccttccttccctgttttctttccttcctgctggttttccaagcaggaaggctacggtggtttgtgtgtttgtgtgtgtatgtgcatgggtgtggtgtgtatgtgtacatgggtgtgtgcataggtgtgcatgtgtatgcatggatgtgtgttcatgtgtgcaggatgtgtgtgtatggatgtgtgtgcatggctgtgtgtacatgtgtatgtatgtgtgtgcacatgggtgtttgtacatggctgtggtatatttgtgtgcatggctgtggtatgtgggcatggctgtggtacgtgtgtgcatgtgtgaatgtrtgtatgtgtgcatagtgtgtgtgcatgactgtggtgtatggtgcatgggtgtatatgtgcccgagtgtgtgtgtgtgtggcggggggtggctatggtgtgtatgtggggagaaggtacctgggcaattcagtgaatcttggatctggaggagaaggaagatggaggaagacacaggcagcttggcagaggtggccacctcccttgcttccacactgggcaggggccacactgggtgctgtgacatgcaccagagaaataggtatctgtcagagaacatgggtctctgatccctatgcagacaggtagactcagaagtgcccaccggccttggcctgagccagggtgggctccactggggaagatgctaggttggacgccagagccactgcttacatgataaggggcctctcctagcctggggcctttggtgacctccctttccactcactgccacagctcctgcaagtccccatgctggacagctgcctgtccactgggttctgycttctgctgcctcatcctcctggctcttggctggctcctggcctctggccctgcctgaaactgaggctcagagaagggaagygaattgtagaaggtcacccgtcagaaaggacagagctgggttttgaatccaggtctcctgactgcaaagcccttgctctttctccttcttccactcttaggggaagtggaggacagggagggggtaagaggggagatttggaagtcacatgggcctggggcccaattccaccccaacacttattctctagggtcaatttgagtacatcttttaaccttcctgagcctcaatttcctctttctcarttggaaaggaagatgctctgtatccctcatggttgtggtggggacaagtgccacctgtaaaacccagcacctagcaaactcctcaaaaatactggttcaggccccagtcccctcctgtcactcctctagattatcctgggagaaataaccctcacccatggaaaccagagcctgatagctccctgcctaaatctctccagtggtttccctgtgcctttagamcaaaatgccttagcatcacctccaaggcctggcagattctgactcctactttacctctaacttctcccctccrcctccattcatgtgccccatccacttgaacattattcccaatgatgcaccaagctctttccctcctcatggtcttygcacatgctgttccctgtgtctgacaaggtcttccttgcattcrttacctggctaagtccttattctcctttaggccccagcttaaaagacaaakgtgcaaagaagcctcttctgctctcctaacttaggtrtccatcactagtattctcacacacagcatttcactgttggttttttagagcaacatagctagtggttaagagagaggcattggaacragattgcctcagatcactggctttgtcccttagtaagtctgtgaccacaggaaaattacttaacttctctgtcccttggcttcttcattttgaaaattggggtgactgtacctatctgtgacaggaagcttttgatatataacaaaccaccccaaagcttagtggctgaaaactgtgactcatttagctctcatttctacagtttggcaatttgggttgggttcagctgggrggttcttccgctgtgggctgggcttggctgaacttggctcatgctcacccaagcatctgcacttagctaggtctggattggctgacacaacttggagttttcctctgtgtgacatgttaccctgggcttgttcacatggaggttgcaagtcccaagagaaataggaaactaagccctaattcccaaacacttttcaagyctccacgtcttacaaattaggatgagagggaactaccaaagagtatggatacaggaggttgtgataaaatgggggccrttactataattagtctaacacactaccccactggggctgttggggggattaaaatgagagttttgcttgtaaagtgcttagcacagtgcctggcttgttaattagcactaaataaataatgarcccttcttattattttgtgaaaaggacctaaggctttgacatattaggtagcttcctttaggacagccctcyccctgacctcccccacccccattaaacrgtggggatttgaatctagtttccacctccctccagggactgacctcttaactartatgctgtgctgctctacccacatagacacataatggcagaaactcacccaaagccatgaggtcagtctgcagatggaccacaattcaagcccaggtctgtgcctgaccccagagccctccacttcactctaayccgccaggttgccttgggtactgtgtttgtcattggtctaaaatttcatagctggaagaaaatatttgttttggtatcctcctccagcactaacaattttctgcttgcatttttctgttgtttggctcagatgaatagcagttttcatctttgctctgtgttatcatgtacacagaactgctgttggggagctaacagcatgcttgcttagtcattattctgagaaggggtgccaaccagtcaatagcctttatttttgtatgactctgtataccacaaatkcagaaataatgcacagcatcsgagtatggcgctactattggacaactatcatttctggagatgggcaaagcagaggtggcaccgcgtggagctggagcygcagaactgattctgacttgcttcttttgtcaggagcccaggagctgggttaacctccctgaatgattcgctgtgatagagtctgtgatagattaggtggtttttcccaaccccaaagagaaagcgaatagcacrggagagatgccaggactggcaaaacttgggggaaaaaggtagattacaggaaatgggggtgagcaggcctaaccgtgaacccagcaaagtggtsgggtgcccacaaaatctttctgtgagccccaaggtgattactcaaggtcaatgcgggttctgtgtggggtctgccatgggaccgccttgcagaatttgggaggtcttaggactgggtcaagcaggatggttagtgccatctgatcggctcacagggatgccaggccagagatgggatgtgagatgaaaggccagaaaatggaaccaaagycagacaggttgcaaccagctcttagaggtcttggcatgggtaaaggcaagtgaacttgttcagtcctttattcaacacatcccgactgagctggagttatgygccaaacactgttctaggtttggaggcctctgtggtgaacaagataaagtccctgcccttgtggagtaaggacacaaaaaggataytattaaattaggtgatggtacaaacgctgtgaagaaaataaacagattgacagaggaaggtkggggagggacacttttaaaaataggcakgaaaggctactttgagactgtgacactggaaccgaggcctgartgatgaggaggagccagtcaagggacactgrggggttgcagggagaagcattccataggaagtgcaaaggccctcgggctggaatgaacttagcatttcaaggggtagmtaaaagcccaacatgactggaagagggaggagatggggccaatttgtgtagggcatcataaaggagtttggattttatcctgtgtgtagtgagaatccacaggaggattttcagcaggggaatggtttgatctgagttctgagaatgtcctagctctgcaggcacgtagttttctagaataaataagaacaagcagatcttgttttcttgaagtggaggggcgtggtggaaggagaccctgaatcagggacttttaactatatggcgaatctcgatggcagcgaagtgtttgataaaggctcttgggagggaatggagatgtgatgacagtgatggggwtgatttattcccccaaaatgttgatccaggattactgtcagrctgggaggagagtctccggtagtgtccctgaggctctgccccagactctctcctgttcaacatttctatttgtaaattggcggaagactcagaagatgtgctcatcagacatgcagctgacatggagctgtcagggacagctaatgccacggatgacaggctcaagattcactgtgatgatcctccacaggctggagtgatgggacgaaaccagcaatattcctgagtgcattcagattggggaacaacgcctggccagggatcagggagaccttgctggataacaatctcctgaaaggaarcccaggctgggggtggggaggaattagtggaggcagctggacccagccaagtccctacatcagcttcttccctctgtggcaaggcccttagcctttcagggtcattcttcccatatgtaaagtggggatgatccaggctactgcccaggcatatgggtaggattaaatatgaacacatatatggatgactggcttcctgtgtggcccatagtaggctcacggcaaatgcaagggaaatattaattgtagaggctggcaagagaagaatggatatcctgcggcaacctttcaagggcacgtagcagggctcacagcyggggcgggcccmtatgttcttgacacaccaatgccagctttctaagagcctcattgattcctgtggtatgtagaggagaatggcctggaggggttggttctggaggccatatcccctgaaacccaccgtgagttcaraatggagacaaggaggtggttgcagctgggggggacatgagtgtttccttaaacaccacaaaggctgcagtgtgggaatgaatggggaagatgctttcttcattgttctggatgcctgtgaggaaaagttgtgcagaggcacatatgggtgcatcgtaactaagatctaaacattgataattacattataataattatgctgtgagcatttctcgagggcccactatgcacccagcttgtgctaagtgttttgtacaacttatagaatgctcacagtctgaccttgacagatgaggaatacaaggtgtagaaggcagctcttgagaggcagagcagggattcacactcagcccctggtagttcctgtctgctagccyggcttcaggttggggagggcaggagtgacctcccaggtgctgagaagggaccatcatggggtgatttttggtacagggatctcagggccctgtggggcttctagaagctactttgagtatgtgcgtgtaatatttgtataaaataaagcagaaagcaaatacagacaaatagaatgactagtrtgtgatgaccctatgtaaccattacctggctttagcaatgattaacatatggccaatcttgtttcatctattactccctctctcttcttttccctcctcctgctggattaattttaaaggcattccccrgcataattttctctgtaaatagtatgtatcgctaagagataaggactctttgttgttgttaggcataaccacaataccattatcacaatttttaaaaattgacctaattgtactgtgtctttctaattcagtgaagctattggtgtatggcttgctttgcaaagtatttggggaggggaggcaaaaactagtctgactcctgtgacttgagactcacctgttccttttgaggtggatgaagaggaagaagaggagggggatctaaaacttgagaccgcagattggcagcccctttattctgattgttctcaggggactcagccgggaaagtgaggcctatttataggcctaagtctagacatgggaaggaggcaaaggaagggaataggtgacaagtcagggaaaggggacagaagagagagtggagggaaagagaaaataacagcaagtgatcttgctgcacacatagctccagtggcccttcaggagctggccgggaccagcccacactagctaatgctcacagctgacactgactgaatgtttcctgtgcacagggcactgtgctgagctcacgtaccagtgacctcgcccaatgctcccaaccatcccatgaggcaggtgatgttaggtgtcacacccattttacaggggaggacactgaggttccagggtccgacatgaaaagagcagtggtgcctggattcaaacccaggtctgtttgtctggagtctgctttttgcaggctttactctctgcctccaagcctggtgatgttccatgtgggggtagagaggctcatgttcaagaagtacggctgtcttggctgctggactattggtacattcccatgtctttagtacatagctcttccccagggtccccaagcaccctgggctaccaagtctttgcctcaggactcatcaggacccagcaactaaaggtttcctgtctggcacaataggaagcctctaagactgtagactgtgtccattctgattgactgttaaatgcagtgactactcccctgggtctgtgtatggtgacatgtgaattgtgtgcctgcctgtttctgttcgtgggtgtgtgtgtgtgtgtgtgtgtgtgtgtgtgcgtttgtacacaataagcattaccaggaaggcatggaccctgctggaagcattccatggtcaccgttttggagactcatcatgccctctgagaggctggccagagctggaacctgtgctggacctccagactgcaaagcctaagccacagcagctgagctcccctatgggactccttgattttttcccttgggtcttcatcatcttctccttcagcgctcccatgatagaaggctgagtastttccagaatgcttggtgtgggccacctcatccacttctcataggagccccttgagtaggcacagcagatggttctaggctggtggctcttgtcctcctgggtgcctgcttgccaagagtgctggtgaggtgggcggggccaccagccaggccagtaggattgcaatcctctctacacctggagagaagtggcaacgaggagcctaaaagccaggagaccatcaggtgctatcagacaggtgcagaccagcaagkgtgcagcggaggacccagggtccaaggggcaggttgaggccattatttaggttcaggaagatcctggtgaatcagtgcagggatcagtgcagrgatctccccactgctggtgctgtacatgaagggaggcccagtccagaggctgtgatcgggtcagaggccatgccagagtgaacatgagtatccaagaggctaccgtatgagatccaggggcggggaccaactaaggctgacagtggtgtaaacatgagagctgacctttgaatcgcccttactctatgccagacaccattcaaagtgctttgcacctctatgatactcctagtaatgagaggaggagacagaataccaagatgctgaacaacctgcccagggtcacaccgatgggagttgactggrtcagggtgtaagcttaggctgtccactccaccattctgcagtgaggtgatgggggctgcgctactctcctgggggcttcccagggctcagccccagcaccctagactctgcacttagagctgttggcttgctcctgacccctttgctgctgggcaaaattccccagtgaaccccttctctggtctttcattgcttcaggttctgagcatgaagaacaaggaggaatggactagaattaaggctcagtgaggctgtgacttgccccagctcactcagcaaggttgttgggagaggatccaggtttccccatttttcaaaaccatgctctcagtgctgcatcctaccgctgtggtataggaccctctgggggtccagtgtgtctgctgggttatcttgcctggaagtgtgtttttgtcatgttatgcatccatctcccttttctggggcctatgtccttctgcaaagccacgccttggtgagctggcactaacaccgtctgtctctctgacccatttccagagctctggagytcagcagtggcaaagatgagatctccttgttggtggaacaggagttcctaagcctcaccaaagagcactcgatcctggtcgamgagagttctggggagctggaggtacccggcagctctcccgaggggaccagagagctggctccctgcattcttgcccctcctctagtggcaggcagtaatgagcgccccagagcctccatcattgtcggagacaagcttctgaagcagaaggtggccatgcccgttatcagcagcaggcaggactgtgattctgccacttctactgtcacagacattctgtgtgmygcygaggtcaagagcagcaaggggacagaggacagrggccgcatcctaggtgactccaacttgsaagtcagcaagcttctgtcccagttcccactgaagtccactgagacatccaaggtccctgacaacaagaatgtgctggacaagacaagggtcaccaaggacttcctacaggacaacctgttcagtggccctggacccaaggagcccacagggctgagcccatttctgctgctgcctccccgacctcctcctgcacgtcctgasaagctccctgagctccctgctcagaagaggcagctcccagtgtttgccaagatctgttccaagcccaaggctgaccctgctgtggagaggcaccacttgatgggtgagtggggttggaactggggtagagtgggcctgcaaggaggaggtccttcccaggaagccaatcagggctgcagcatgtacataaagcatcttcatgcaaagcaagacaaagcagcctctctggtgggcacagccccgagggacgggctgtttccagcccccacaggcttattttgctgggttcccctgtgcagggcacagcttttgtaagcaaacccagaggccctgatctcaacatactttgagaagagaaataggcgccatgtagtaattggcttaactttggaatcaaacgrgtgtccagagtacattgaaggaagtgtttaccctagctgggttcagggtgaaactacagcatggagatgccaagatgtatagaagagaaatttgattggtagctggggtcatttggcatctatctcatggaggtaccttgaggacatgaggcctggtcctccctctctggggtattgggtagatgcgtaaattatccaggcatagtgcagactgttgactctgggatctgtttcctgggacttactttattgaggagctcacattcttcccaggaaagccagccacctcccaagcttctcctactttatgcccaggattctgtgtgttgttctgatctaaccagtcagactatatggttccaagaaggtaggctgatggccatggccattgcctagagtcagcagtcactaagagagtgatcatactcatgttagccaaaagaacaatttcctctgggctatgagcatggatggataactgagagacacccgtattgggagggtccaaattaatctacctgagaaaataagagcaaagtcatcctgaacattctgtgtcctggagcattgcaggaaggccaaggaatcagagctgtggatagcaagctgaactctgggtcctggacaggcttctaggagccagagggctttaggatggggagctgtaggagagagacggttgagctcttcccagagaggagaccttcctcctacctcttctccagaagggacccatagatatttccctgttggatggggctgctggactggaggcagttctggtcccacccaccccacccaccattggtgcatgtctgtgtgtacgaatgtgtgagcaaaagtgtgccaaaaggagttttgaaggttttagtgtatttgttagagaaaatgcaagagtggtgtgtctaagcatgtctgtgtacacatttgtgcatatgtctgtcatgtatgtacttgwgtatgtgtaactaagtcaaaggaacaacagataggagtgtgtctatgtctgtgtgcccagacctgggacgagggagcttcgtagatgtttaaggcatctgtaaatatgagtgggaagctgcaggtgtgtgtgtctctggggaaagggctattatcagtgggtactgttatttcagctcacaggctaggggctgaattcggcaaccggaggaactcctggaaaagactctagggatgttttgctaaaaatgttgtttccttctaaattggctcaggctagagcagctctttcctttgctggaatagtgctaggaagacagccttagccccgaagctcagcccccaagccgctgggctaggggrccaaaagctggtgggatctggtctattattatcaacaggtaacactgaggcacaggtcctttctggctgcatccagacagatcccgrtgcctgctattgggcagcacagtgcacagccatctggtgggtggccaggtttcccaccactgctgtggaggatcctgtgatggtccccaaagtatgtctgcattgggagaataaatgctcagtctctttagtgagaaacctgtgtctgccaccaatcttgtccctgctccacactctagccatatccagtgactcacaatgtctccttgatgcttccaggcctttgcccacagttatccctgcctgccatgccttcctccccaatacccctggatgtaaggcctcgctgcaaccctacttccttctggaaggaaccttctcagacagaagcagcctcagccaccctgttctccatttcttccctctgccacctcatggtgttcatctaccttatcctggggctatttctgggcatgtctctctttttktcttgttatgagctcctgcagggcacagtctagctctgactcacaactgtgtccccagcactcaggtcaaggcctggcactgacaagtgagctgaatcacctgtgagtaataaaacaaaagtagaatccagaatgagagaccaaagtgtgtggctcagaccacatgttctgtaagaatgtgtgactccttcactaagccatgtgctcactgaaggcaggaactgtgtccacaacatccttgttttcgcagcctggcactatggatggttggagagaaggaatagtggaaggaatgaggaaaagtaaggaaggagaggaaagaaaagaaaggtaattcgaataaaggaatgatggaaggaaggatgaaggggtggatggatggaaggaaggcaggaagataaagatggatagtcagacaaatggatggacagatggatggatggataagtagacggatagaaggaagaaaggcaaagatgatggacagatgggtggatgaatgaacagatggatggattgatggatgcatgagatcggggggcaggggccagggagggtttcagggagagattgggattgtatttggctgaaagagagtcccccaaagtggtccaagcctcaggtgtgtgctgcagaggattcatcatttagtccacaaaaaggtgcttccagcatccagcacttggccttccagaggcattgactcagtttctttcctgctacagaatggagccctggcaccaaggagccaaaaaagggtcaagggagcctctttctcagccagtggccccagagccagaaggacgcctgtggtgaggagggttgctgtgacgcagtgggcaccgcatcactgaccctgccgcccaagaaacctacatgtccagccgagaagaacttgctctatgagttccttggggccaccaagaacccaagcgggcagccgagacttcgaaacaaagtggaagtggatgggccggagctgaaatgtgagctgacctacccagggagggattggaggggagggggttgcagtgaccctcacaggcttcagggtggctctgtcaccaagtggctgtcttatctactgcctttctagaggtgtcagtttttaaacccataaaatgggggcaatgactttctccccatatcccttgttgggaatacagttgctagagaagtgtagttggctttcaagggtcacgtcagcattattaatggtcacttctgaatatagccctgacccagcatgtattatatcctctcaaattgcccaagccaaaacaaaagwtccttgctttagattatttctatattgagattatgttcccgctttcttttcctacaagggttctagtcaaacctcttttcccaaaaggatgccaataagrggaaactgaggacccatttctgattttataagcccccacaacatcttgtagaaaggaagaatccaggattctgatcttgaaacaactcaacctaacttcatttgtttagaccaattttgagtcactgcatgctgaattatttaatgttttaaaatataatttttaaaattcccatatagatacaacaacctgtgaaagtttcttagtgttgccaaatatatgtccttagggaggggctgctttaatcatttgataaggatgaattccaatggcatagcaatggttcacataaagttggatttttccaaagcagttgaaagaatttcattttgtaagtaggtgaaatataggcctagcaatctggcttattgtattcccttgctaaattgccttctttactagtgaatgatggaaagaaaagctccaagccagaccttctgggattttcatcccttccaaactggcaaggtgtgaactaatgatgtttacctatagttggaaatgtactagaactttgaagaaccctcttggagcttaaaggacctgacctgtgagactgtgaatccctaaggaagttgcgatgctgaaggtgtcctggcctctccctgcctccatcactgacccgctttgcctctcctgtgacttgcagttaaygcacctgtgacggttgctgacaagaacaacccgaagtacacagggaatgttttcactccacactttcctacagccatgacctcagcaaccctgaaccagccactctggctcaacctgaactatccacctccaccagtgttcacgaatcactctaccttcttgcagtatcaggtmagtgagctggcctggctctcctgtggacatccacgggggttttggccacagagaaggagtggctggcagggggtctatttcacagagtctttagactcctctgaatcccttccctacatgcaagaggcttcgctggggctatggaagggcgctgtcaacttgtcagcttgttggttatttttttcattgtagtcacatcagatctaccccttggttcatgtgcatgcgtgcgcacacctccacacacacacacatatgtatatttagtcctaactttccattgtccgaattccagttcacactgtgctctttattgcagagtctctttgctagttgtggctggttaagtgcttgggctcccaggagaagatgatgtcacagtccttgtttcccacctctctcctgtgacttcctttgaagttggatgacatatatcccagattatttgggacagtcccaatttaggtcttctgttccagaataatatgaatggcatcccttttcactctcaagtgtcctggtttggacaacaaattacagtcagccctctgtatccatgggttccaaatccacagattcaaccaatcttggatggaaactacttgaagaagaaaacaacaacaacaacaacaaaatacaacaacaaaaaataatgcgagtaaaagataatacagtataataactatttacatagtacattattaggcgttgttagtaatctagagattaaaggatacaggagcatgcgcataagctacatgcaaatactatgccattttatattagggacttgagcatcctcatatgccattttatatcaggcacttgaacatctttatatgtcattgtatatcagggactagatcatcctcatatgccattttattttatttgagacagagtctcactctatcgcccaggctggagtgcagtggcatgaccttggctcactgcaacctctgcatcccaggttgaagcgattctcctacctcagcctcccaagtagctgggattactggtatgtgygctaatttttgtatttttagtagagactgggtttcaccatgttggccaggctggtcttgaactccccgcctcatgtgatccacctgcttccacctcccaaagagctgggagtacaggggtgagccaccgcacccggccctcaaatgccattttatatcagagacttgagcatctttgtatgtcattttatatcagggacttgagcatcctcagattttggtatccacagggcaggggagggagggtggtcttggaaccaatcctctgaggataccgtggaatgagtgtatatggccaccttacttaaactacaccaagcagtcttagctttgtaccaaccaaggtggcttggcacacattcttgttcttgggatcatagctaaaggagaaaatcaatggccagacacaaagggacagtgaagcacctgtagcagggctggaaattctactcacagaacttatttatgcagggaaaatgtagtttctttattttgtcgatttaacttaatatcccttaagagctgccgcccactgggtagaaggagggaaaaattaaataaatgtccactctggtttaagccttagcccaatccaataacttaaatagtccctttaggtagaactcaattttttcaggaaagattctccatgcctaagatttctgtcttctgttcctcgcactggcttctctccagaattgtatgtcattgtatggggaagggcaggaactcaaatttgtgcactcaggaccttggcaatttgctgccccagcctggcccagcacagcctgaagtgagaaagcaaagaaggaaatacttccaactcggcttgtcctkttgctatgtcccttccccgctctccactcctaggaaccctatgtcattctttccctttcaacacagcacaaaccttatgtcctattgggaaaggggattggctcttctgcatataaagactcttcaagctggtccaccaggcttagtttctgaatcttaaaggaacttagcaaagtctctctctgttttgttttcaagctttttgtttgtgtgtgtgtttgctaaagagaacaagtacccgtcccctcccgagggagggaaagctcacaccccattgtggaggtgagaggttgtgatgaaaggtgacctaagaaggaagctgaagtggaccagtttcatattagtagtctattgtcatggacctgttcatatcagtagtctattgtcyttacacaggtcttgaaatgtcctgttcattgattcgctgactcctttaccaatatgattctaccctttcatttttgtgtgcctattcactattcatttactcacctactcacgatttactcatttctatgtatttatttactcattaatttaagtaattttgaaaaccatttctccctacaagcctacyagaggctgagcattgttctaggtggagggattcaaagatgactaaagtcaggtgtggtggcatgtgcctggagtcccagcctacaccagaggctgagataggagaattgcttgagctcaggtgttcaagactagcctgaacaatatagtgaaaccctgtctctaaaaaaaaaaaatgatgactaagaaaagcttggagtctaatgcaagttcaggaataaaccagagatcagctctatgcatctccacctstaaaggggaaacaactgcataattcatttagtacaagtcgattcactctaaaatgccctcacagagctcaccgtgtaaaactaatttgcaatggtttgctttattaagtggggatagcatctctttgctatgttaatttcttctgactttttggagtgggtgagatttggacatatcattttctgagcatgacggtcctctgtctttagcatcatagggctgactatgaggttcctgggcttctgagcagaagcagcagaaggaccctggctggtaaggcctgctgggttctttgagacagtttaagcactgaatgggcccagctgaagttggctgtggaaggcattggtcctcccaggtaataaggaaggacagcataatttaccttctcccagcttctgtgatctcacaatgctgtccagcttcaacatagctgatcaaggggcctgagataatagcaggcaggttttgaaaycagtagacttgactttaaaggttctgctgcttccaagttaggccttaggctggttagctgctcagagccatggttcctcatttgtgaaatgggttcataataattgcagcagcagcagcagtagctactgatatggttgtaaggattaattgagtccatggaagggtaaagactctgtaaaatttaagctgtgacacagatgttggtttttattattattcagcctcaatcttccaaggaaatggggtcagagagctccacagaccttgaggggacagagaggagaaatggggaacagtctagcctggtcttttccctgtttagcaytgggaataaagataaggtcccaaatccaatttactcagagctctgtggtaggaggactcagagatgtgaaagacaaagtccccaacacsgaggagcttcagaggctcctgggctacttggcataaaggaactctgctcccaatgaaggagggagggtgcgtgggaagggaccatggcttaagcaaagaacagtgaatgtttatttacccttgcctgtgatgttacaaacttgcaattctaacaactagaaatgttgttgaagtcatgcagtgttttctaactcatgagtgtggcaccatctcctgagaatccgccctgggactgagcagcggtgggcagctgtttgccatccacagagcctagggcagcctggcacaagcaggtgtgggatggtggaggctggggaagttggctgtagaaagcaaggggcaccttcctccctggtgctcccaggaggaccagggccaccagcttaagccctctgctgtccctactgtatgggctcctgtgaggggtggatggcatggcccatgctgggcattctggagactgctcagtgctgtacctgagggagaagatgatgaaaaagaggcagagggaagatgaaagattcccatagggaagctcagctgctgcaacttaggctctgcggtctggaggcatagctctkgtcaccctctaagagggtacgatgagtctcaaaaatggtgacatggaatgctcccagcagagatctttgtgtatgatgccgtgcacacacacaattgcacacaaacgatatccatgcatgtttgatgcacacacatagaaacagaaacaggcaggcgcaygactgcctgtagaaagcagagaygagtgctaacagggatcagaggaggcggcgaaacagaggagggacacttagcaacatgcctagtggccttggagctcatggagggctgagaacaggtaaggcaacaccatcagtctcactgctctgtccaggttcaggcagaggctggggttgcagggaccgggcagtggtcataacaggagagagaggctgccctgggctgtagagcttggagtaaaggggagcaggtgagtggtttcaggtgaaggagtggacaaaagtgggaggggcctgagcatgggaatgtcaggagtgtcccctgcatgggagcagagagcaaggaggggctctgagaagaggtacactcttggggacctggaagatggagcaggaggagagcagggagacctacttgcagactccatatcagaaagtccacaggccatgagggaaccctcaagggtgtagggtcagccatcatcaacactttggtcattggcacaagctgagctgagaatggaggcagcctctcgggcagcagatcttctgagaagatgtcctgggctgaggggtactttgggttttgagcctcatcttaagggaaaactcgggattgacaggtggaggcagagtctgagactagaactgaccactgccacagcagcagttctgcggggtgtgtgtgtgtgtgtgtgtgtgtgtgtgtgtgtgtgtcttacgtctgtgtgtggacacatgagcacctcaagacagaattgtgagtaaaatgtcaatttcccatctggctgaactgccagaaagctgtttaagggaggaggcagtgatggatgacaaacacactgaacattgagtccttactatgtgcagggcactgttstaagctctttagatgtattaacactttcaccctcacagtgcccctctccgtaagctacagacacaggtatatggatgggcacatagatacacagcaacactaacacacctgggttcacagttgtatatttgtacacagaaatacacagctgcatagacacaaatgtaaacacacatgcaggtgtatttaacatggatgcaaaccaacacacacacgtagagacgtgcatagacaccttgtgtcttcagggggcaggtatgggattaggggaaggcatttagaaaagttgtgtggacagcaacaaagataatgtggctaccttcataggctttgcaggcctgagcacatgcaattttttagagaaggaaaaagaggctcagagatgtgatttgcccaaggtcacacagccactaaaacacagatctgggactcgggaggcagtcaggctcctgaagctcctgtctcccacactcatcagaaaggctgtgaaggctgcctaagaggggcttcctgtgtgatgtgagtcctgcttctcctggcctggttccagctggcctcagacagcccatgggtctggtcagcaatgtgatgggacaaactcagtcctgtctgggaactgagctgagtagctgmtgccttctggcaggaaaccccttgcctggccatactgagcctctgtttctccccagggcctgtacccacagcaggcagcgaggatgccctatcagcaggctttgcacccgcagctgggatgttactcccaacaggtgagtagaygatctctcctcctctgtcctgggtccatgaaggcctttgggtcagagggtgcatctgctccctcctccttttccagctggtgaccagacacctggcccaccattggctctggagtacagactcacataccggcatgcgtgtggaaaacacaaaccgatgtccgtatgtgacaacactgggcacttaatggagcccttcctgtgtgctgggcctgtccgtaaggactgtgtctgcactaactaatttagccttcaaaattaccctgtgaggtaggttatagatgaggaaacccaagcacagagagattaagtaagtaacttgcccaaagtaataaagttacttgggaacatacaaattaggtgttgctgtggcaatacataaccgccacatctcggggactttcaacaatgaatattaatttcttgctcgggtctatgggctggctgagctgggctgtggatcaggtttaggtgggttccatgtgcctctcctgggcctctgctgaagattcagtacctcttgctctttccacggtggatggcaagagcccaacagggcaagcagaaacacgtgatgcctctgaaatcctcaactcagacctgtccgtgggaacttccacccaccttccactggccaacgcaaacgacatggctttgctcagcatcagtgagactgaggagtcatattcttcccacgcagggttgccagttaaaatccaggacacccagttaaatttgaatttcagataaacaaggaaaaaatgtgtagtgtaagtatgtcccaaatattgcacaggatatacttatgctaaaaatatgtattagttatctgaaatttgaacgtaactgggtgtcctgtatttttatttgctaaatctggcaacactactttcatgggtaggtcaggataaatatctgtgggacaataattgaggtttgacctttggcaggctggtactccaatgaccaygctttactacatcttgtacctagatgcacaataatactgcctgaaaataaagcagcagaaagagaaatgcaaacacacacacacacacacacacacacacacacacatgcagayagaaacacaggtatagttgtacacatgccaccaagctgcaggagcctgtgtgcaggcacagggacacaaatagatacagaagcacattgaggggtattgagtcttggggcagggatgggggtgtgaggaaaggagcttagaatggaggagcagagggcaccaacacccagcctgccatagcmccaggctggccttgctcctccacacaaatgtggacacccccacactccaactcatacaacctctgcctytcctgtctccccagggagccccaccctccgtgcaaaccgcacctctgacctgaaatgtgttagaatgttcgggagggtagggaagagcctgcaggggtagggagccttgttacctgggccagcactgatttctcagcagcaggaacccttgcatcctgagatgaatctgggatgagagatgatctgggtcaggkaatctcagccccattgcctccaccccttgaacaagaatatcgtccacctggctccagagagaatatttttarataattatgtgtatgtgtrtgcatgcatgcatgtgtatgtatttgaaaaaagtaatataaaaacatggtaaaaaattttaaaacttggaggcaatcactgtttaatggttttttacatattttcccggcaatatctatttatataaacatttttaaataaatgcggcattctgggcacacwgttccattgcttttgtcagtgaggattatatttggagatggctccagagcaggctacaaagctctactttatagtttcatcagatacatggaatcaggggcacatttttttataacactgtgtgaactytaggacctgcctcctccacttcaatcccctcccaggtccaggcacttcctcccccatgaggacaggggtactttctgccatgctgacccatasggtcatgactcccatctgacctgcgaggtgctcttggcatgttctgacctttagctcatcaccttgggatttggtgcctgcgcccagcatcaccaggccccacatctccactggagaacattggggaagaccgggagggaggactcaggtttccaaagaggacacagcatrgagaggctagtgagaaccaaggtataggctccgggcttaccctgctggggttctgaccacaactcagacgctggaaacactgagaaagttgcttcacttctctgaacctcagatttcctgcttccaaactggaaataataatggccctacctcacagggctttctggagttttaacgacagcatccatgtgaagggccgggcacattttaagcagtcaatgagtgctagmctttgtggattgtttttttttttttagacggagtctcgctctgttgcccaggctggagtgcagtggcacaatcttggctcactgcaacctccacctcctaggttcaagcaattctcctgcctcagcctcccgagtagctgggactacaggcatgtaccaccacgcctgactaattgttgtatttttggtagagacagggtttcaccatattggccaggctggtctcaaactcctgaccttgtgatccacccacctcgtcctcccaaagtgctcggttacaggcgtgagccaacgcacccagccccctttgtggatttttttttttagataaggktgtatggggtgagagagggctgtcagagtgcctgattcctgagcacttggaccccagacttgctattaaagtggaaatccagaagtttcttcaaattctaactgatactcccctcagtacacaagaggatagacatcagctccgtatgagaaaaggttttctcatatttggagctgtcagtagtggaatgtagtgctcattaggtaacgagccccccatcatttaggtattcaagcagatgccttagtggtcttttctttcctccctccttccttctgcccgtctttgctttcctctctctccctttcttgcattcattcatttaacatatgtttgttaagcagtgactgtgtcccaggcactgtcttagggctggggagatagtggtcaacaagatggatgaggtctctgacttgtcgcggcaagatggtgggagccccagttctaggtcggagttcatcacgggcaatctcrgaagcaccactgaattcctgtatttccctagagtttgtgctcaaccccattgcctttttttgcccttcctcctagactcacactgtctactatggcagccaccagctatgtgtggctatttaaattagctaaaattaagtataattcaaaactcagttcctcatgcccatgagccacatttcaaatgctcaattgtcgtgtgtggccggtggcttccatgtcacacggcacagatgtaggacattgctgccatcccaggactttccactgggtagggctgtctcggacttgcaatctgttgaaaggctctcaagagagatagaagccagagctgtgtaaatcacaacagctttttggggataatgaaagccttaaaaataaacaaggagcttttgagatggttattgacagagggaaaagctrggcaaacagggaagagaatggaaataatattgatttgctatttactatatgcctgtctctctacttgtatcacctgactctatccccactaacaacgtagatagtgttttcccattttgcagatggggaaactgaggctcagataaattaggtaacttgccaggctcactacataagttgagccctaggctttctccattccaacatgttgccttctgtgtacccagcagtgactgaggagcacaggggctgagactgggggtgggtggctggggttagagttgggctggggaatggtgacctcacccctctcttctctgtgatgtgcaggtgaygccatacaacccacagcagatgggacagcagatcttccgctcttcctacacccctctgctgagctacatcccttttgtccagcccaattatccctaccctcagaggacacctccaaagatgtctgccaacccccgagaccctcccctaatggcaggagatggaccgcagtacctctttccccaaggatatgggtgagtcagcccacactgggagcctaagggtatccagaaagctggtgggaacgggggcaagttgggtgggcttaccagcgctttcttagtatgtgtgttccatggctgtggggtgggatgggccctgtacctgtggctggtggttgtgtgggtcctggagggacctggtgcagagatgaagagggtctggggcctggtgggccccttttgtaggtgcatttcaggtctggttgcagaaatgcaactgcacggtccataacatatggatacccctactccataggcaggggcagttggtgcaacgatgcatttgcctttacccatgtgcttggttacaacaggacatggccagctaatytccttagagctctcacctcccactgtccgcaccctgatctccttgcaaggctaatctccccaacatcccattgactttgtgatgggccctgcggaagagccttcgactgcttatcagggctgcccacacttttccaccaagttccccaaactgcagaggcaaggagctcctacttcctgggacagtctgaaggcttaacagcaaacagccagcacaaactcaacattctggctgaaaattctactcaaattgtgcatgctgttgagtcataaatttgtgtttgttttaatataataatacatagccwttcattcccacccaccaaatcttccactaatatggatgctccaaggggcasgtggtgccctgtcattcctgggaatcccagtctcccgggcacaccctggggaatgggtgcctgggtttgagaaactcactttataggattaaggccaaccttcccagcctgacagtgattcccatccttccacctccccatcacagaaccttccctgcagtgccgacccatgtccccaaactctcatcctttcaatcagtattttctccaaatagcttgttgaaagggataaatgcagcaagtggtttcagtagtcagatctgtttgggaaaagctgtgggaaacagagataaacagatttcttaactgttggaattctcagatcatttaatttcctagggtrcacggagaatgttcaagaaggtggtcgatagtattatttaaacatgaaatccacacccttttmtttttttattttattattattatttttttgagatggagtttcacccttgttgtccaggctggagtgcaatggcgtgatctcggctcactgcaatctccgcctcccaggttcaagcgattatctcacctcagccttccgagtagctgggattacagacgtccaccaccacacccagctaatttttgtatttttagtagagacggggtttcaccatgttggccaggctggtctcaaactcctgacctcaggtcatctgcctgcctcagcctcccaaagtgctgggattacagccatgagccaccgtgcccagcatccacatccttttaaaaaaaatattccttccttccttccttccttctttcctccctccctccctcttttcctctctccctccctttctcttcctttctcttgtagagtatatcatggtgtgttctacctaacacacccagggaaacgctgtgttgacacatgtagttaatttgaatttagcctgcaggggacctatagatgaataggacatgcttcttcccttcagagaactgagagcagatgaaatgtgggcacaacaatgttagtgccctggcaaagtgaaaaccatcaaagtggcccgaggacaraggyagaatccctgcagcgggggaggttccagtgagcagcactgggaggagggcattccaggcaggaggagcaaggccctcagatgggaaagcaagtggcaagctggaggcctggggaataaaggagtctggctgaagaattagatttgtctctgaaaaaggtggaaaataggattggaaaagggaggttgagactagattatgaaaggctttggactgctaggcctggggatccagggaagatttatgcacatcagagtgaattgatgggctggaagtaagagaaagaggaagcaggatagggtggggtctagaggtggctctaggggcctatgggacagattatcatcccctggaggtgagaatagagacccagacaagccccctgcaggttggccaacttcccacattctgtgctgtgactctgggctctgggaagatagacttgctgtaggagatagccctggctgtgtctgggagggagggtggtctcaatgtctcctcagtcagctttcgggaaccaccgactgggagctgtgagaccagaaggttgagacttggtctccacaygtctgcagaggtcggaggagtgggtaggcagcccgagraaggagcagcctgagaagtgagagacagcctggggaaagccagagacagtggaggcaaagaggagggtgaggagaaggagcagggtggattggcgttctgagaggctggggagaccaggaccatgaggtcggaaaaataatgtaagggatgcaagcctgagtacccagaggggatgatctgttcattcaaaaaatattgatccagcaccttgtatgtgcctggcactgttgtagacacyagggataatgaagtgaacgaaaaaaaggttttccttctcctaaggagctttcattctagaaggagaaatggacaataaggagataaacaggcaagcatgcaaggccaggtcctcaggatatgggttggggtggggagaagaatcaagggcagcctcttgagccaagatctaaatgagatgagagaatgaaccacacatacatttcggggatgagcctctgggcagaaataatagaaagtgcaagggctctgaggtgggaacctgtggctgcagcacaaacagtgagggagggagtgcatggaattaaaataagaggtagccagggccagactagacagggcctggtaggcatggctagaagtcttgtttcaggagcagtggaaaaccatgtaggcttttaaattgatgaggacatgttctaatcttctatataaaacagatcacattggtcaatgtctgaagaatggactatgagggtaagagctgaggcaggggagtaggctagagctttatagttgagcaagaggcattggtgggatggataaaggcagtgaccctgggaaagggggcaggtgaaaagatctgtgatgtgttattttcttggtagaattggtgggacgtgatgatggttgaatgtgtgatgagggaaagggaaaagtcaaacaaattccttggtttttgacttgtgcaactggagcagcagcaatgccaaaacactaaggtcattgggccaggcacagtggctcacgcctgtaatcccagcactttgggagaccgaggtgggtggatcacttgaggtcaggagttcgagaccagcctggccaagatggtaaaaccccatctctactaaaaatacacaaattagctgggcataatcgtgggtgcctataatcccagctactcgggaggctgaggcaggagaattgcttgaaccagggaggcggaggttgcagtgagccgagatcatgccattgtattccagcctgggtgacagagcacaactccatctcaaaaacaaaacaaaataaaacaaacaaacaaacaaaaaacaaaaaatgaccaaggtcatgatgaccacagcaaggatctgtttaccaagagtcagtcttagacatgtgaaaattgagaaagtcattagacagatgggtggagctatggataggtaggtgcatataggagtctggaactcaggggagaggttggggctggtaatacgtttgggagccattctcatatacatgatatttcaaggcaagggatgggatgggatgagatggcccaaaatacacaagtatagagaagagaagagatccaagggctgagccttgagacttccagcatgtagaggctgcggagatgtggaggaaccagcaaagattctgtgaataagtaggactatctagtgaggtggggaaaaaaatgggaaagtggagtgcaggaagccaagtgaagaaagtgtttcctgaacaaagtgctggtgttggggtggtgacgcgaggtgctgatggaacaagatcaaggtgaggctgcacctggctggggagtatgcatgggcctaagcagagagttcagcatggaagacaaggaaggtcagcagaaaaggtggaatcaagagacaaaactgtgtgaaggggagaggaaggagtgagaggcttccatgtcctcagggaaggagaagtagagccctcccctctgccaagtcaatttgcacacattcatcatggtggaataaccatacaatttatcttccaagcaataataaatttgagagttaaaaggagtacagataataattatatcaggccagacacggtggctcacaactgtattcccagcactttgggaggccaaggcaggtggatcacctgaggtcaggagtttgagaccagcctggccaacacagtgaaaccccatctctaccaaaaatacaaaaaattagccaggtgtgatggtgcacacatgtagtcccaactactggggagaatgaggcacaggaatcgcttggacctgggaagcagagattgcggtgagtcaagatcatgccactgcactccagcctgggtgacagagtaagactctgtttcaaataaatgaaactataaaataattataccagaaataccaacatagaggccggcccaggcaaaccaggacatatgttcgtcstactcaacaggcaactcaagctcctcctcctccaggaagcattacttgttaactctcgtccacacagattgctcctcttcctggccctctagcrtacatactgtctagatcatgccggtggccgttgatctgatcagaagttctcaacctggaggacctagctgcatgtgtgccaatcagatatgagctgtgtcatgatcattgttgattactgataattgttaaatactgaagtatgggttacagcctttattttgtaagtcagagtggaaggcagggtatccctataataacatcattatgatttctgaatgatcctccaatatgatttctgaaagagagaaacagaggtggggttaccgctggcatggattgcttatgagggacccacaytgtgtcaggccctgggcacatgatatgaaataggtaaagtctctgctctcttggcacttattttagtgagaagctagtgagacaacccagcccaacttgcccatggagactcagtgagcaagagacagagttagctgctgaggcactacaaatgaatgccgtggtctatttccattgcttcttccctcctctgctcccgctttttgtttcatcaattcatagaagggtaccatgaatgtgaatctcttctataatatgcatctgcccagctgaaaagtgattgagaatcccaggattagattaaatctagccatttgctctattgtaatttgtattgagttctgttcccattcattcaaagtatctgagcagatgggtgaagaaattacagtaggattccagcagtgtgagtaaatgattccatctggagaggtcagggaagtcttcacagaggagatggcttttgaactctattttgaagtatggataggagtgtgccagggagaaaaggagaggcgtgtgcatttctgctcttagacggtgaggctcacgtcttaacccttccttccctgagggtctagcaaagccctaggcactcagtgatgtctcaatgcttatttctgagtcagggatggagtgaagggcctgatttagcttagtgctggaaggggaggagggactctgggattgtccagccccaaagaccttatgctggacttgcctctaagttctctgatgttgtagattttcctgagggacatgtctggtcctctaaggcaggtagagtggtcacaggaatacaggtaagatgcttaggtccagagagggtccctgttctatgggtcttgggcagggagagagtgtaggctccattgaaacaatctttacaggctcccagggacttcctgatccaagtaagcataaggagaagcgcttgattgtcctctaattgtattattttaatattttactttcccagggccaaagcctttcttatgccaaagcctttaccctccaagcctgtcatggtcttcactgtttctgacaaccataaaattaatatatatatttttctaattctctccgataacattaggaatctcatcatggcatccaccctccctctcttccaggttcggctcgacatccggagggcccttgatgcacagcccctatttttcttccagtgggaatggcataaacttttagatctcctcttctcccttctcctcccttagcccttggatcaggactaggggctctgatttttggattctgcaaaagcttggtatgaagtttggaaaagcaargttctgaccaggtcacagacaaaacagcaagaccagattcatctattggccaacactgacacaaaaatagccctcctcacacatggcacaagctacacacacacacacgaccctcatattcatacttgcttgctcaaccacttatgcatctrtatttagctaacatgagtgatttttgtttttgtttttgttggtaaaatagaagtaagacacttaattttagaaagtttgtattttatgataaaagtatgagctacttgaaatggagtgtgcctgtttatttttgtggtgttctgtgtaatctttacctctcattttccccacgagactcagcgtttactcagggcatgaaaggagaccacaggctggagtcctcagagtgctgctatctaaatattggacctcagggatcataagtgagagggcttatctcttttcccctgtgatccactcacctctcaacatcccagtgtatgcatctcaggaagggacatcataaacggaatgcactctgtcctatcccgagtggaagttttccataaaaagtctcttttggacaaacgattgggaaatgtagcctggaaaacaatttcaaaattgatgctaaatgtggcagactatatccaatgattgtacatcagtaccaagatagaggtcaatgtcaaaactgcacctaatggtggcatccttagacctgtcttgttcaactcttaccaatgactcgaataaggacattgagagcaacttgatcacattgatggaggacatgagtctgggaagaggagacagcctggatttgtgacagcacacattctttaactcttctgttgcacccccttggcagacatcgctaatcagctctgtcattctatccccatgagcttggagaaagccacagagtcattcttcctgtggtgccccaggcagctgtcactgatcagagttggtctatgaaatgaaacccatgtggcatgctctcacagtgtaaccccatcggcctcactggtctttctttctgggtccctggaaaccaatttctctcccaagttccctcaagacttatgccttcttacattcttcatggcctaagtctaggattccctggaagtccttcaactcccttccccaatgctggaccctactttgggcatttcttgtttcttcttgatagccttggttaacagtctgtcccaaaggtctttcttatattgtacttctaggtattgatccaggctagactataatttgccaccctcccttgatctcagcattttgggaaacaggagacagtaaaagaaaaattatgggtttgcctttggccagacttggcttcttagctgctttccaactatgacttagggcacagaacttaacttctctgaacctcttttccatgattggccatattaagagttgtgaggattaaaagataatgcagacttaatataaactttgaattttgaggattaaaagataatgtagacttaatataaactttgtctatttaacatagacttgtggctttaagatggtggagtaaagatgtttcttttcctcttctcttgaaacttacccccaaataacaaggagaacaagtaaacctgtatgaactctatcctcaataaaactcggagaagttggcaatcccatcccatatacaaaagcagaaatgggatggaggaaaggtaaattccttagcagaacagaggaagatcacatggaaatgcctgccaaaggaaatatcaacaagaagctagccatttctcctgcagagccctgatggtcctggaattggaggtgccaggtgctagactccatggaaggtggggctaggaagaggtgaaagcaacctggccccacaaagccaaaggccatggccagttctgtaggagacaggaggcattttctcaggagaaaggtacagaccatgcataaggactgtggagatgaggccccagatggaaaattggaatcaagtgaaatacacatacactcctcaatgccagcagctaggctttaaccaagaagcagaggtttggaaggtcctctagggaagctgaatttccccaaggcgtttggaggtaccagtgaaaattaccctatgattaatgtccttttacaaagagcttccaataaactttttagagcagtctccaccaagaaggaaataaatcaaagataagaaggaactaaggagagacagaccataatagtctaagggagataaggtagtacattttaaaaataaggacaatatgccatatgcttatttttaaaaatcagaacaagaaagtgtttttggaaattaaaacaatgatagctgatgtaattttttaagtgaaagggctggaagttaacatcagagagatctcatgaaaggagaataaagacataagggtgggttataggagataaaagataagcaaatgagaggaccagtccaggagaaccaatatctggctaagggacattctaggcaacagagtgaaaatcaaggggatggaaatactaatgaaaaaaataaaagaaaatcccccagattgaaaggcccaaacaagtgctcagcaaagtgaaagaagaagatgtacattgaagactatccctatgaaatttcagaagagcaaggataaagacaagattctaaaatttcccaaaaaaccaactgacatacaaatgctcaagaaccaaaatggcatcagagttctcaacagtaacactggcacctagaacatcctgaaacaaaggcaacagaacttcgagtggaaataattttcgaccaagaattctaaatccaaactctgccctgtgaaggtagaataagatgttttcagatatgaaaagtctcaaaaaattgaccaccctgcacatctgtcaggaagctaagggaagatgtactccactaagacaagtgggtaaacaaagaaagaagacatggaatccaggaatcaggtattcaatgtggagggaggctaaggagattcctggggtgacggaaaaggaatgccttcactcaggagccatgaaacagagcctctgagagccaccaccaccagtccagatgtaagtaggaagttggtgagctccagaagagaggcatatcagtgggggctggggaagggctggagaaaaaaaatgatagattattctgacagagttgattctgtggaaaattgtattaagaggtgttttatagcagttggtgggggtgggaagctttaactataaattcaaattaaaaaaggaacaattgttattaactcagcagtgaacagtatttacctggtcacaacaataaaaagttcaaatatagatttaacaaaaaatggtgataacttataaccacggtgggaggatgaaggtggagagagggtgtgaatagagctaaaatcctcatttatcataatagaaaggcaggaggtaatatctaaaatggatgataccagagatagtggaattcatataattatctagaaatctggagataaacaccaagataaacagccaagagatttagggggattgatttgtgggggaagacggtgcaggaatcactgccttgtttgtaagtctttatagcactgtttggcttttaaactatgtgtatgcattattttaataaaaataaagatttatttaaaagagagagaagttgcatgtagaacactaatatgatgcttggcacatggtaggtatcaaaaatgcttgttgaattgtatcaagctaccttcttttttttcttttttttttttttttgagacggagcctcgctctgtcgccctggctggagtgcagtggcgcaatctcggctcactgcaagctccgcctcccgagttcacgccattctcctgcctcagcctccccagcagctgggactacaggcgcacgccaccacgcccggctaatttttttgtatttttagtagagacggggtttcaccatgttagccgggagggtctccatctcctgaccttgtgatctgcccgccttggactcccaaagtgctgggattacaggtgtgagccaccgcgcctggcctcaaactgccttctgacacagatagagcccactgccccagctctcatcccaggatgtttgagaatcagattctcagaagtccttagaaacttttttctccagaaattcttatggagaaaatttagttgaagcgggggcctggagccaatggccaatgcttttccaacacattgcacccctgactctgctcacctctcagggaattccagaaatagttatagttgaagaataatgggaacagggaccctcagtgcttttcctgatccagcgtcatgaagtctggatgggactgaaaactcccagctcttctcagcttttctctgggttccttcaaacccaccttcccccacccgatgcattcagcgcacagtcactgaaaacgtatccttagggatacagcagtgggcaagacagacacagtgcctggccctgtgaatttttaagcacagatactcaatcatagtcaccgtgaaaggtgatgaggttaccaaaggcacacactgggtgctatgagagcacatatcaggatcacccaatccagttcagagggtcagataagtgatgtctgctccttttttttttttgagatggagtctcactctgttgccaggctggagtgcagtggcgcaatctcagctcactgcaacctctgcctcccgggttcgggttcaagtgattctcctgcctcagcctttcgagtaactgggactacaggcgtgtgccaccacacccagctaatttttgtaattttagtacagacaggttttcaccatggtggccaggatggtctcgatctcttgacctcgtgatctgcccgcctcagcctcccaagtgctgggattacaggcgtgagccactgtgccaggccaagtgatgtctgctcttttaacattcctggtccttgcagtgaattcccatgtgacatgttttcgagttgtaagcctccagttttcttcctggacacactctatttgtgaatttctctctctcttttttattttagaaggagtctcgctgtgtcccccaggctggagtgcagtggcacgatctcagctcactgcaacctccacctcccgtgttcaagcaattctcctgtctcagccaagtagctaggactataagcacacaccaccacacctggttaatttttgtattttcagtagagatggggtttccccatattggtcagactggtctcaaactcctgacctcaggtgatccacccatctcggcctcctaaagtgctgggattacaggtgtgagccaccgagcccagcctatttgtgaaccttaacactaacagtggtctttatatagtttaagcaagttgaggagtagcattttgtgggagttctagaaatacttcataaaataataccagctactaatcatcaagcacttacaatggaacaggcacagtgctatatacatcacctttattatctaatgctcataataaccctgtgagatatatatttattacaggtgcagaaactaaggttcacagtgaatatcttgtttcaggtcacgcagtgagccaacattcttacccacttttcctggtccttccctgtttctcataacacagcccgcagtgaatgaactttgttggaacttataccatatggttcatggctattaaattttcagacaactaagacttctgagtcattttccagtatgagccagtgtcataagaaagtaggaggcaggggccgaggaggtcagggaagcagcggtggattctccataagaaagggagaggtcacctgaagcagagaaatcagctctcagccttcaaactcctcctccagggcttcaaatccttctcccagcctccctcctttgggaggacttcctcagtcctgtgttatacgttcctccatactacagagattgtcgattggtaccaaatatgcattccctctttctccttagtaaaggaaccccactttcagagtgacacatggccttccagaatatgtgacttacttacagccaaatgggatgtaagcagaagtgttctgtgtggtttctggaggtggagtcctcatgatcaggttggtagagcaaccagcctcaagaaggaactgggcctcttagtacctttgagaatgtagaatggccaaaccaaccctcccacaagggagtgcctatccctaggttttgtttacatgagaggaaagtgaatgctttttaaaagctactgtaattttgggtttctttc

SEQ ID NO: 12443 - DNA, 12723 bp, Homo sapiens
tcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcagttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacataagagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttggtgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcattggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccggtggctaataaagtagatgagtttcaggattgcaaaatattgtgatcctggcctttgtccattgtgtaatcttcacagtgaccagagtgtttgcagttcctaggaagttcacccattcccaacagtgtcccagggtcaagctcagatgacctgtggtatttttatacccatatatgtgtcaatgtttataacttttaaagttgttttcaggaagcactgaggcatgtggtcgttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactctttagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaacaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccagcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggtaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactacaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttctgcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacatgattgagttacctcgccctgggtccctcccacaacatgtgggaattctgggagatataattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagccataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatataagagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggtgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttctctgtaagtggaagtggtattcattgatcacacactacatgccggacaccaagctattacattttttgaatatgtttcttctttgcctcttgaggactaaccagccgggtttagattatttcctccccgtgtcgctttcctgcccccacatgttaaagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaaaccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctattggacacatgtcctaataataaacgtgatataatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcctccccaacctaaggaaactgagacccagaggttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggacaggatgaaggaaagaagcagtgttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagacaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggccccctgggagtcagagcgttccctccctccttgccactgtaaatgactatttctgtcgtttgcagagtgtccttttctttctcctacagccccatccttaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttgctgagcatctatctgtagcactgcatgtcaagccaagctagagtacagtctcttaggagacacaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaa

SEQ ID NO: 12444 - DNA, 12870 bp, Homo sapiens
attcacattaatcaagtatgtattaaggatttttttttttttttttttttttgagacaaatctcactctgtcacccaggcttgaatgcagtggtgtgatgacagctcactgcagcctcaacctcctgggctcaaccagtccgactacctcagcctcctgagtagctgggaccacaggcatacaccaccaaacctggctagtttttgtattttttgtggaggtgaggtgtcatcatgttgcccaggcctgtctcggattcctgggcttaagcaatcctccctcctaggcctcccaatgtgttaggattacaggtgtgagccaccacacctggcccaagaatcttaaaatgttcatacccctaggcagtagttaacatttctatggatttattcaaaggaagaaaatctgaaatgtagacaaagtattaaatatgagtgttcatttcaggattacttgtcatagagacaaatgagaaataatagaaatggcaaaatgaaggtcataattaagcaatttataatgtacccagccagtggagtcttaggcaggccttacaatggatgtttatggaagagtttttaatggcataaaaatatgtatgtgtgtgtgtgtgtgtgttctggtttgtttatccctgaatattttaatgtgttttttctaaaaatagagatttttttaaacctgaaaataatcaaaatcaggaaattaatgatgatatgacaccatatcaccattacttaatccacagacataaactcattattgtcctaataatatgctttatagcaaaaggaaaatttttttcttctagtccaggatacagtagctgcagtgaaccacctcaaaaggaggagcaacactaagatgtcccatgtccagaggtgatggaagaaagttggaacaaaagatactccggggaaattgacaagggaattaactggggacctgtagcaggagcagccaggcctatcagccttggatttctccacctaccctgcatgtaagagtttagggggcaaggacttggattaatgagaaggggtcatgtattgagtggctgtcaaaatctgggaggaatgagaaacatccaagcctaaaagaccagctgctgagcttcccacctagcagcaggtcctgcctatcaacattgtatggaggcacaagctcagtaactgttttgctcttctctatacacaggcagctcaaccaaaggcagctgtcagcctaacaagacattgcaactcaaaaatgcacacagtcaaggatcaccaaatgcatgaggagtgcaatactataaaaaagagatcacagatccagcagatggacaaatgcacacctgaagaaagagagttaatagggaaaaccagaactagacttaaaaataaatgtgattataaatcatcagagagataagaaagtattttattcatgatacaggaatagctggttgtaaacaagaaacagaaattttgtaataaaatatataattattgaaataaaaaatacatgggctagtagcagaatgaacacagttaaagggtgaatcagggaactggaagatgtggtatgggaattctttcagaatgcaacacgaagtaagagagatggattttaaaaagaaacaaaaggtaaagatatagcgaatagattcaatattcatctaataagagttctagaattacaggccagagataacagggagaaagtatcatttaaagaaataataactagagattttccagtattttttaaaaagtaggttctcagattgaaaggtttcactaggtaccaataaaataattttttaacccacatctggactcatcatagtgaaactgcacaacatcaaagataaagaaaaaattctaaatgctcagagaaaaaaaaattagatgtacccactagaaaagaataatatcagatgtttttagcaacataaattcaataccttcaaaatgctaaagtaagggatatttcagtttattattttatagccaaattatatttaaatgtgaggatgaaatacaggtattttcaaacataaaaatactcagaagatttactcactccttcccttccagatcctttttggggaaaaagaaaagcaattagatgttgtactctagttaagaaaaaaacccaagaggaaacagtggcatgcaaaaaccaaaggtgaatttcttttattgagtcaaggtctctctctgtggcccagactagagtatagtggcacaaacatggctcactgcaaccttgaactcctgggctcaagcaatcctgggtgtagctgggagcctttcaagtagttgggaccacaggtgtgcaccaccatgcccagctattttttattttttgttgaaacagggtctcaccatgttgtccaggctggtcttgaactccctgactcaagcaatcctcctgcctcggcctcccaaagtgctgagattataggcatgagccaccacactcagctgtgaatttcttaaaatgattgaataaatcttatttttatctaaataacttcctgaaaagttataacaacctggaactaaaatttgaggttagcatactgagtatgcataggaatattccacaaaaagtggaggtaatgaaattaagcttcctgttaatatttttgccttgtttgggtgatggtaaaacataatgatgggaggccattgttttgaacaaagctcctgccctaggcctcaacaggccaggctaaaaaccaaaatggagtcacccatgctaaagttccatctcaccaaacagaaagtaagttgttatcggaccttctgagaaatcaggatgaaaccgacccaacagtcccatagattttttttgataaacatagaaatggacacttctggtcttaaagcttgaaacgtacatttgttttattagttccttcttcaggaaagaaacccctggcttctcaagaagtatcaaataaatgaaactcaagagatcatagtattcagacaatgagatgacaggcccctcattcatcatgattgtgtccttaccccaagttcctgttttcccacttgtggttacatttcttccctgttatataaacccctaattttagtcaatcagggagatggatttgagactgatctcctttctcctcagctgaagctctcagttaaatccttctttcttggcaacactttttgcctcagtcattggctttctgtgctgtgagcagcaggacctagaccaaggacctagacctgttaccttttggtaacaagaggagagagataacagccaattccccaaataggccagttacaatcagctgataatgaagttccctccactttaatccctaccaaaaaagtaacctgaagttaaccaatcagttacctttccactattctttctctctgtccctgccttacaaaaaaagtaactttgtgaaattaccagtccacttttcattctttgtttctggtttcttcagctcttctctgcctataaaaaccaacctcttctgctcagctcatcagaatacttattctattttgtggaataaagtgttgcctgattctagaaatgcgaataaagccaattaagatgtttaaactaaatttgttgtaattttgtcttttgacagtgaagacatagataccaattagttctttaaaatatacttgcatatgtgcattaaaaatgaatgttaataagcacatgaaaagaattcaacattagtcattagggaaatgcaaataaaaaccacaatgaggcacctcactacacccaccaggcttgctataataaaaaagatagacaataaaaagtattggcaaggatgtggaaaaattggaaccctcatacattgctgatggaattgtaaaatagtacagccactttggaaaactatttggcggttcctcaaaatgttaaacatagagttactatataatccagcaattctactcctggtacatacccaagaaaagtgaaaacatatgttcacacaaaaatctgtatacaaatgttcatagcagcactattcataatagctaaaaattggaaacaactaaaatgtccgttggctggtagatggatatacaaaatgtggtatactcatacaatggaatattattcaacaataaaaaggaatgaggtactgatacatgctataacaagtaaaccttgggaatattataagcaaaacaagttaaacacaacaggccatatattgtacgaccctatttatttacttatttcagagacagtgtctcaccatgttgccaaggctggagtgcagtggctgttcacaggcatgatcatcacgctctacagcctggaaattctggggctccaagaatctgcctgcctcagctgggaccaccagtgcacaccaccatgcccagctgtgtatgattccatttacatgaaatgtccagaaggggaaaatccacagagacagaaaatacgttaatgattgccaggtcctggagggaggggaaaatgagaagtgactgctaatggctgcaggggtgatgaaaatgtcctgaaattagatagtggtaatggttggacaactctgtaaatgtatgaaaaaatgcccaatatatacttaatttttaaattttatttatttttttgagacagggtttcactctgttatccaggttggagtgcagtggctcaatcaaggctcattgcaacctctgccttatgggttcaagcaatcctcccacctcagcctcccaagtagctgggattacaggtgcacaccaccacacccagctaatttttttgtatttttggtagagacggggtttctccatgttgctgggtctcaaactcctgggctcaagtgatctgcccatctcggcctcctaaagtgctgggattacaggtgtgagccattgtgcctggccatcattagatactttaaaagggtgaattttatggtatgtgaattgtatcttaataaaccttttttttgtttgagatggagtctcgctcggttgcccaggctggagtgcagtggtgtgatctcaactcactgcaacctccacctcccagggtcaagtgattctcctgcctcagcctcccgagtagctgagattacaggcacgcaccaccacgcctggctaatttttgtatttttagtagagacggggtttcaccatgttggtcaggctggtctcaaactcctgaccttgtgatccccctgcctcggcctcccaaagtgctgggattacaggtgtgagccaccgcgcccagcccaacctgttgtttttttaaagaaaagaatgttacaatagaatattattcagcaaaaaaaatgaagaactgacacatgctacaacatgaatgaaccttgaagacattatgcgaagtgaaataagccaggcacaaaggctaaatattgtatgattccatctatatgtggtagtgaaattcatagagacaaaaagtaaaatggcagttgggagggcaggagggggaaaatggggaattagcgttcaatgggtacagagtttcagttggggaagatgaaaactttctggaaatggatggtagtaatggctgtgcaacaatgcatatgtatttaatgccactgaactttacacttcaaaatggttaagatcatcagtcattggcaccatcctgcaatctaaggctcaggttcagtgctcttcaaggacactgggccccactgggcaggaatcctggccttgcagggccctagacaggcatagaggagagccatgtccagacaccccatgctccacattctggggacccgggtccatgaagtgcaggctgcagcactggtgagagctggaactttcaaccgcccagaaaggcggtagcccaggcttatactgcagtgcctggctcctcttagcaactaagacagtgccttggcctggggcaggcagcactggggatttgtggccaggtgggcagtgcagcttctcattgctggggctttactgggagcttgggagggtgaggctacccagcagccataatggtgcacatgaatgtcctggttgatgctctcaagagcatcaacaatgctgagaagaggagtaaatgccaggttcttattaggccgttctccaaagtcatcatccagtttctaactgtgatratgaagcatggctacattggtgatttgaaaccattgatgatcacagagctgagaaaatagtgaacctcacaggcaggttaaacaagtgtggagtgatcagccccagatttgatgtgtgttggtccgtttcatattgctataaagaaatacttgaggctgggtaatatataaagaaaagagatttattttggctcacagttctgcaasctgtacaagaagcatagcaccggcatctgcttctggtgaaggcctcrggaagcttccgctcatggcacaaggtgaagtgggagcaggcacatcacatggcaagaatggaagcaagggatggagggagggggccacactccttyaaacaatcccatctcgatgaactctcagagccagaactcactccttatggcaaggagggcaccaagccattcttaagtcatctgcccccatgactcaaacacctcccactgggccccaccttcaacactgcagatcacatttcaacatgagatttggagcgggacacacatccaaaccatatcaatgtccaactcaaagatctagaaaaacggcagaataacctgctttcatcccaccagtttcaattcattgtactaacaacctcagctggcatcatggaccataagaaaaagcaagacaataacacatttgagggaaaatcctgggattctttttctaggggtgtaatacatacctataaataaaatgtcttagtggaccctggtgcttccaaaacatgaataaataaaatggttaaaacctggcaaatatcagcaaaaataattttcatgctgataaaaggaatacttttccaaaaaattataacacgagtttacatatctaacaacatagctttgaaatatacagcaagagtttatggattactaaataatttataatttgtatacaattggaatcatatagctgtgtgtgtctgtgtgtgtgtgtgtgtgtgtgtgtgtgtgtgtgtgtgtgtctgtgtattttttttttttttgagatggagtctcactctgtcacccaggctggagtaaagtggtgcaatctcagctcactgcaacctctgcctcccatgttcaagcgattatcctgcctcagcctcctgagtagctgggattacaggcacacaccaccatgcccgaataatttttgtatttttagtagagatggggtttcaccatgttggccaggctggtcttgaactcctgacctgaggtgatccacccacctcggcctcccaaagtgctgggattacaggtgtgagccaccgtgcccggtctttttttttttttttttttttagacagattcttgctctgtcacccaggctggagtacagtggcatgatcatacctcactataaccttgaactcctgggctcaaggggtcctcctgccttagcctcccaagtagatgggactacaagcacagactactgcacctggctaattttttagtttttgtaaagatggggtctcactttgttacccagtctggtctcaaactcctgggttcaagtgatcctcttatttctgcctcccaaaatgctgagattacaggcatgagccactgtgcccagcctagacctatatttatattgagagactcacacacattcatcagacactgacaaatcaagaagacaaaaaagtatagagtatctaaagagcaaaacagtattagtttaagtcacactagcaactgtagcaaataaacttttaactaagagtagctgaacacttagacaatcgaggttaatttctttttcatgtaaagttcaatgtttggttgtggggcacggaggaagggtctctgccaggaattcaagctgatagaaactctgccaccttcaacatgtagttgccaaggtcactctgtgtgttgagatcttggcattcatagtgacagacagaaaggagaaacacacgtaagctgggcctggaagtggcacacataatttctgctcatgctccattggccaaaactcagtacaagaccacatctaattgcaaaaagtccaggaaatgtagcctagttgtgtgcccaggaggaaggggaacaagtttgttcatcaattagctagtctttaacacagcaaagaacagacgacctgtcaatgtaatggatatatgtagaactttgaatagaaaatgtacattcttcacaaatacaaatggaacatttataaaaattgactaagtattgactaagtatttaactgcacagtaagttccaaaaaaattttttaagtgatatagctgggcacagtcccagctacttaggaggaggaggtaggatgattgcttgagcccaggagtttgagtccagcctgagcaacatagcaagaccccatctcaaaaaataagtaagtaagtaaagtgaaataatataaaacatttaatgataaaattttatgtcaacaacaacaggaagatggctagaaatttgtatacaccgagaagttttaaaacacaggtctaaataattaatgagttgacaaaaaactacaataaaattagaattaactgaagtactactttaagatgacgttaaagtagtcttcagggaaatatataaacttacttgcacttactataaagcaagaaagactaatgatgaattaacttagcttttgcattggttccctagggctgccataacaaattaccacacactgtgtggcttaacacaatagacatttattgtctaatagttttggaggctagaactgaaatcaaagtgttggtgacaccatgttctcactgaaggaggtggcttcctagcctcttactgtcttctgatgattgccagcaatccttggcttatagacacatcactccaatctctgcttcagtcatcacatggcattctccctgtgtgtctgtctcagggtccaaatttctcttttcttataagaacaccagtcatattggatttagggcccaccttaatccagtatgttgtgtttggccattgaggtattggagttttctgttacagcactgagcctactaacaaggtacatcattagatgtattctcattaatgtcaagagcaagattagaatacccactattccccttcttcatcatacccaacttcatgcaataagattacctccaaaatagacatataaatattagaagagaagaagacaaagcaaagcattaattatatacagatgagatttggttgccttctctagaagacctaaaagaaccaatgaacaaactgtcagaattaatagtaccaatgtaccaaaattaattgcctttctacttacaagtataagctatgagaaaatgtaattggaaaaaaacaatagtaacaaagactataaagtctttaggaaaaattttagtaaaagatctttatgaaggtgattttaaacttgactaaaacacattttaaaagacccaataaatcaacatgtcagattcttggatagaaagacgctatattcgagatacatttctcaaaatctaggtatgaatttgatgcaataacaatcaaattactcaaaagacttttcacagaccttcataaatgaattcgtatggaagaatacatgtacaggaagaaccaaggcaatgaaacagaaaaagtgggtaaattgcccatcagctgttaagatacattataaatcaatagtcaaaacagtgtagtatttgcataaaaatagaaaaggagataaatggataaatggaaaagagtaaagggtcaggaaatagatctgcgtttatatggggatttggtatatgatagaggtggtattcaaaatcagtggaaaaaagactattcaataattggtattaaagcaattaacgacccatatgcaaagcaacaaaattagattcctatcacatacatacaccaaaataaatccagatggagtcaatgttttaatgtttaaaaaaaagataagtaaatagatactttaaattattagtgaaaaacgtagatcaaatctttttgaacaaaaaacaaaaatctataaaggaaaatacataaattttgccatattaagtatttaaaattctgcatgtcaaaagacattgcaaacaagattaaaaaataatcagcagactgaggaaaatgcttgtgatagatacagaaaaaaagatagtggcctaaatatataaagcaactctataaactaattttttaaatagccagtaaacaatatgcttaatcatactaataatcaggaaaatcatacaaaaataaattattttcactcagtagattctaaaaaatttaagtttttttaaaaaagtgaagtcttataatcaagcaaagcagtgttataagctaacaaggatgctcattatacgcagtagctttagagggcaatttggcagtgtggattaaaagtaaataaatgcatattcagcaattctacttccgtgcatctaccaccagagaaacactagcccctgtgcagaagaacatgcaaaggttattcattgtagaatttatcacagtagcaaaaaattggaaccaatgtatatgctcatcaagaacaaaatgggtagatacaaagtggcttatacataagattgaataatataggtgtcaaatgagcaaaaaagaaaaaagcaaattgcagagaaaacattataccattgtgtaaaacacatatacaatataatatatatatatacatttattattacactgtacatttcctgtgggtctacataaatgaaataggtataaataaatgaaaaatgagtgtaaataagtgggaaaaaaattaaatggtctgcaaaattaatacatcaaagaacccagggctgtgggtggtgatcagacagatctttagctttaatattctaagtttaatattaattattaaacaattaaatgaaattattaaaaattacaacataattaaaaatacaatttacgctgcacaagaaaaaaattagagaaaaaagactgaaaggaaatgtacaacaatgtataacaatggttgcctctgggtgatgtgtttatgggtgattttcctttctgcttttttttcctttcattttctgtactttacacattttctgaaatggccatgtgttactttataattagccatgaaaaatgaaaaagaaaaataaagagcgtttaaaaaacccactgtcaaattcagtctttaaagagcagtgtgcttacttcccttcccccaaagaggccctgacatttagaaacaatataaaacactctgaagcaccgtttaatcctattactcttctggacctcttacaaacctggggatgatccctttgactctttaaaataaatctcccaaggtcatggggttcgtcagtaacagagggggatgaaactcccaggccagtgctcctcccctgcgccatctggcacctcagaatttcagcaaagatttattgcttgagctagccaaaaagccaaatgctcaaatgcatcttctttctaagggaatattactccacttaggaccactctactaacttgccactgcctcctttctgggcctcagtttcctcgtctgtaaaataaggggattgtgttgtctcagcaggtctggaaattccaggttcctaaaacatcctgtgtgccttttctcttcccagctacttcaaaggatccgcttcttcatgcttgctctatggtgatcactgggagatcgtttccaatcctggttctgcagcgaatttatgtcctgggtgtccctgggcaatgcagtgcctgtctggggacctcagttttcccatctctacaaggagggtttgggcccagaccagagtttttccacaatctgggaaggtgaagtggggtgacttagctccctataggtctgtttcgcaaactgaggttcttggtaaggttttctttgaaacgagaatctttagctacaaacctgcttgaaaaccactgggcaaggagacttcgcaagctcttttccaggactgacattctgtttctccatgagcagcagaacactaggtaccagggtaaaataatgaagatgactcccttggcttggggcttccatcctactccctcttggggggctgagctgttcagtattaagatctgaaatgctcggatcagctcagcccccacttcttcctctcgctccccgtcacctaggcaaccgggcggggcctgggcgcgcggttcctccctcccctttctccccactccaacgccaggctgcattcccaccctctgcctccgcctctgcccacagcttctctgcgtctggagtcgcgagttccaccagtcgggctgcgttttgtgaacatggaaaccagatttcaagcgggggggccccaacgcccgaaaatgatcctagtttgcatgctagatttgcctggcttcttgacggacgtgttgcagccaaagggtctgaccttgccagggcaacgtatgcagagctttggaggcctgagacgggcttgttggtgctcagggggccaggaacaggcagggtgctctaataccagagcatcctagaacgcccgggcaaacagccgtgagagggggacagcgggtcgtccgaggtgggggctggaagcacgcatctgagtggttctctgctccacgtggggagtcaggagcaaagggccatggggtataatttcccacggagttatctctgtgaccctgtggccagggctgggggcctgggtccgcgtgggagtccacgctgggctcatgataatgggcatatgggggcaaatgaataggaagagatca

SEQ ID NO: 12445 - DNA, 41299 bp, Homo sapiens
  misc_feature (1)...(41299): n = A,T,C or G, or insertion/deletion polymorphism (see Tables 1-2)
ggctgccgtgcacaagtgtggtggctactgctgctcaccatggcccacagggtcacagggaggaggctgaggcagcagcagcccttgctgccaggtgccttgagacatttgggaccacctcctttccttagacagcctcccctccacctgccagaccttgaggagaccctggagccaacagccctcaatatacccgatgggagctgcttgcttcctctgggaaggcactgtgagccccaccgacccctctccagctcgccctgcacacaggctgactcctccaaaactgagagactttcagggccaggctgtccatccctggtccctcaataaaggactgagcaaacactagcctgtggagttgggtgggcatggggcaccggaggcatctgcctccccccaggaggccactgcagctcagcccttctgtgccctgggcccctcctcaccgcaccccccccaccacaccatccggggcagaggaaacacaggaggctacagcacagagcctttttaattttttctgtgctatgcacagaagctgtatgaggacagatgtgtgccttctttttttttttttttgagatggagtcccgctctgtcacccaggctggagtgcaatggcgcgatctcagctcactgcaagccccgcctcctgggttcacgccgttctcctgcctcagcctcgcaagtagctgggactacaggcacccaccaccacgtccagctagttttttgtattttttaatatagacggggtttcaccatgttagccaggatggtctcaatctcctgacctcctgatctcgtgatccgcccacctcagcctcccaaagtgctgggattacaggcgtgagccaccacgaccagccccagctgtgtgccttcttatggccacaccaggaggcactatggtccgggcacacatcaggccctccagaccctgcagcacttctcacagctgctgctgtggggcctccagcatcttgggccaaataccagatcttccagggtggggccagtgggcctgctgggtcttggcggctctcagaaccagggaagcaggggtggccctgcctgccgtgggagctccggacacgatctgtggccagggtctgagtgactgagcgtggccaggtcggctctgcttctgcaactcctcgtgtgcttatgagtggacgccctgccctgccttacttcagggacccctcacgccctgccccctgcctcactgcagggaccactctgctcccaattgtccacccagagaccctccacagcggccacctgaccactggctttcaatggaactctctcccgcgataggccgagggccttggtgacctccagctcactcagtctcagggagccccagggtttcagcacatccttctagagtctttccagctgcacccatgaggctggggccaggtgaagacagagaagcatccaggagcccacatctaaggaggcccccactcccagcgccatccgaatgcaggtaggtcttaaaaaggaatgcctcagggccaggcgcggtggctcaagcctgtaatcccagcacttcgggaggctgagatgggaggatggcttgagcccgtgagttccagactagcttgggcaatacggcgagaccctgtctctactaaaaccttaaaaagaaaaaaaaaaaaaagccaggtctggtggtgcaagcctgtagtcccagtgactcagctgaggtgactggatcacttgagcctgggaggcagaggctgcagcgagctgcaatcatagccctgcactccagcctgggcaacagagcgagaccttatctaaaaaacaaaaagtgcttccttaaattttgcacccaggtgccccctctggcctcaccctgatcctgaggcctccgtctacctgggttcgttctaacctgcgtgaccatcattctagcatttgtctggcacaggtcatgtggctgtgccttgttctcaggctcctcagccagctgggtggctcctggggctgtaatctcaccatctcagatgtcgagattacttttcatacttccttatcttgttaataaagatgggacaaaatcatagcttgtaaaaaactgggatgatggtgaacccagttctgaggcttcactttctgcttttgtttggttctccatgctgtcaaattctctgaagaggctgttgccctcctgagtcagctgcagcccagcaaggccctagaagagcctctgctggtggacagaggagctgctgcatgcagacgaggaagctgggctgagggccggcaccagggcacggggcagggaggctgcgggtcccgggtctcatgggtctcagttctatggaggtgcctgtcagtccaggtattcagtcccccaaccccgtctttgggtctcagtggtactggatccaggtgtacctttgggagaagctgttgagaagctggctgagggaggaccacccacgtgcacgcccatgctcttatgtggatccccgggatcataaccttgtggctgacacatttcctctccaaggctgtgctgtcctccacgacttgctgggtcccctcaaggcccttgcctgtgtgggtggggtgctcatgggaatgagggtcttgggaggggggggtgggaaatcaaacaacacagggatggggtagctgccacagtccccaccaatggggtctcctgggcagtgacccggcattctgcctccagtggctgcagtgggagtcctgatctcaggccagggaggggacgtgcaatggtggtccagacctggtcccattcctggccaggctcagtaaagttactggccagtttctgggcctcggtctcccccaggttattcagccttgagagttagtcaccatgcctgtgattctgcctcatcttcttgtgtcaaatagggagggtttttcttggcagaatggtggtaagactctgagccagaaggagactctcccagagaaggcagcagagagcaagagcaccagggccttctcaaggcctccgagagccagctgggcctgggcagtagatttgtgggagggtgccctgttgggactctgctgacagggagtcctcagggcttgtgtgagtgctctcaaagtcacaggatgggatgatcacctcctttctccaggccaggcagccagcgccggaaagctctgcagccccctgcgcggcctggagaagggcttccttccagttttaagtcagtgtttctgtctcattgccatgctcgcccccagtgctacgtcctgcaccaaccattgccacttcatactgaccaggtggaaccaaacactcacattccagttggctccccatccctccccagggagaacagatccacaggtggtgcacctgtgagtggagtggaggctggccacgggcctcatcacacctgccttccttgctcaaaagccctgcccagaacatgcctcggtcccaaaaaagggtacactgggccctaacccacatgcctcataatctttaagcagaaacagcaagcagattacgggacaggacagatcacgctagtaggattaagcttagaatatcccagataatcgcggatgcccctcccccaatgggggagttattccccttaacttctgaggattaaggggaataagaaaaagaagaagggctgggtgcagtggctcacaccagtaatcccagcactttgggaggccaaggcgggtggataacttgaggtcaggagttccagaccagcctgtccaatgtggtgaaaccccgtctctactaaaaatacaacaatcagccgggtgtggcagcacgcacctgtagtcctggctactcgggaggctgaggcagaattgcttgaacccgggaggtggaggtcgcagtgagccgagatcgcaccactgcactccaacctgggtgacagagcaagactcggtctaaaaaaaaaaaaaagaaaaaagaaaaagacggataaaagaagacagaaacatgggagtatttcctttgcacaagaatccaaggtctagaatgaagagatggtgaaatgaagccagcctccaggaaggtgcactgtgccttaatgggacctggggatgggaaggccaacacagaggtgtcagcgggacaaacacaaagtgtttctaacaagagcaaagatttccagtcttctctttatttccaaacactctgtaggtaaagcagagcctcagtaaacccaagaagcagaaaacctggcctcctgcctggggcagcttcagtttagacttttcttcattcctaacagcataaagaggctgtgcaaatgggaggcactcagcagagcctgaagaactctggggtcttagctcctgggaggccacacatgcttggtggcaccctgccggtcacggtgcctccaaaagctcccaatgatcagtggcctttcttttttttcttttttttcttagacagggtctcactctttgccaggctgcagtggcgggatcttggttcagtgcaacctctgcctcccaggtccagggagtcctcctatctcagcctcccaagtagctaagaccacaggcaagcaccaccacgcccggcaaattttttgtatttttagtagagctggggttttgccatattgtccgggctggtctcgaactcctggcctcaagtgatccacccgcctccgcctcccaaagtgctgggattacaagcaagagtcaccccactcggccagtgtggcccttcttcaggtcatcacttgccagccgcaggcggtggctctgcccctcaccggacacgacgtcacagccgggatgtgaacagcagattctgatctccaactccagacaatcactgatttacttctgcaaaccggagctgtccggtcttgcagggtcggaccatgtaaacaagcctgctgccaggcaactgaagacagaaacacgaataaagatgccccataaggaatgaaaaacaaaactcctcttgggaaacccagatttgggattcggaaacgggcttgagatcaacctgaagcttcatgacgtcttactgtttccactgcctttcctgttccactacagcaacgccctccacttcacgtgccaagtcctgactttctcctaatagttgccgacccagcaccccgtaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgggtggcggccggcgcccggtggggcatggcgggttcgcggggtgcggggcgcacggcggcgccgagcgtgcggccggagaagcggcggtctgagcccgaactggagcctgagcccgagccggaggtgactgtggcgatgcggggcggcggggcgcgtccctagagggcccggcgggcacgtggccgcgctggggcgggtgggcccggcttctgtcacctgggcgcccgcgcccagtgaatcggtcttgggcgtgggtgcagctcctctatcggggggtctcaggcagagcggactgcggggtaaaggacggcgtccgggaagcaaagaaacgggggagcggggagtggggacggggcgccccttgcagcagcctctccagccgttccatttgtgcatcctgccaataaaagggctcggcttgcgctcccagtaaatgcttaacctacgtatacgctagttaattgcgtttttatgctcatgggatagacatgagaataagaaaacctgaatagaacccagtgtctgctgcatttgctgtattagaactcactgttgctctctgctagctcagccctgtcttggttgtggggatcatcaaattgggtggtggaggggatggacagccagcccctcacagccccctcggccgcggccgckctgggttgttgaaactgccccattgctttgtgaagcgaattcaactcatcctggctcccatgggctgaatggcccgcaggccactctaggcgccaggttctgcgacttccacccttggactaaacggtcctcaggagccagttgtttgcgcccaggccacggatgccatttccactagttattgtgattgtgtagccgactgaataccaagacacatcatgactctgtgtgagagaggcattgtgtgaacactcggtatgcaatagctaatacatgcaggtcgtaccttaagtgagacttgtaaactattaggaaaacagtaaaatctagaattctgcattcaactgcttcctttttcttttcttttccttttctttcttttttcttttttttttttttgagacagagcctggctctgttgcccaggctagagtgcagtggtgcagtcttggctcactgcagcttccacctcctggctaactcagcctcctgagtagctgggattagaggtgcccgccaccaccagctaatttttgtatttttagtagagatggtttcaccatgttggccaggctggtcttgaactcctgacctcaggtgatccacccgcctcagcctcccaaagtgttgggattacaggagtgagccactgtgcctggccttcarctgcttcctaagagtctaagttcttgttccaccctttaaggccagtgaaggacccraacactgtgtgtgccggtgtcacgcagccagcagggctctgctcagaggcagctgtggtcctgctcagagagaggagtgggtgggttggtgcgtggttgcggttagagtctctatcattcctgtgactcttcagccaatcctttcaatttactgatcaatcgttggtcccaatctggttaaatgaggaggcgtctgcttcaggtggtaaaagccctttggggacccatttctcttccagcccccagccccttttctagtgacctcttggctctggggccttggatgccagggtgaggtgtggagagggctcaggcaggctgtctgagggacccagtggagtccagcccagcctgaccccacagggcctccggagtgtcagtgggtggtagagagcagtgttagttttgcgatgagagctgagctccaagaggaggaggttgtccttgaaaagccccttccctgtgaggtgctaggaattaaaatgtcgatggcaaaggcaagaggctgtcttgtcagtggaggtagaagatgaggaaggctcaggttgggtggatgcttttggtggaagtttgtgactggaggggtgtggtcctggaggccacatggagctgctggtgggtggctggaggggcgagaggcagctctccctgcagtgttcagtgccccatgcctggaggggcagttgtcaccaacccagtgtttccttgcagccccccctcctctgcacctctcctctcagccacagcaccggcagcgattctggcgtctccgacagcgaggaragtgtgttctcaggcctggaagattccggcagtgacagcagtgaggatgatgacgaaggcgacgaggagggagaggacggagcccttgatgacgagggccacagtgggattaaaaagaccactgaggagcaggtgcaggtgggtgagcgaggagccccctcgagggctgtcccccatgtgcaggtggccttgggctttctgagactgccactgtactgccttctccaccgtccctcagaaccccaaggccggcgtccctccttcactgcacctggggcacgcttgggctctaggacgctggtttccatccccagttgcgtgccgttcccaggaactctgaaaatccacatgcctaggcccttccccgtcagacgatgctcgggcaaccctcctggcaacaggttgggtttccttgaggtggggattttactgcttggaatccagtggcaggacccagctgaggagggagctgagcagcatggcagggctcaagcaggcggcatgggggccccaacggaacccagctgggcctgaccccacagggcttcaggggcctgagcagccgacgggtagagggtttaacattgtacctgttgcagcgatggtgggggaggatgcaccctactcttattgagaacaacaggagaaaagcataatttaactaaaacacagcatttgttatttttttttattttttatttttttgagacagagtcttactctgtcgcccaggctggagtgcagtggtgtgatcttggctcactgcaagtaattctcctgcctcagcctctctagtagctgggattacaggtacatgccatcacgcccggctaatttttgtacttttagtagagacagggttttgccgtgttggccaggctggtctcgatttcctgacctcaggtgagccaccacgcccggcctattttttttttttttttctaagacagagtcttgctctgttgcccaggctggagtgcagtggggcgatcttggctcactgcatcttccacctcctgggttcaaacaattctcctgtctcagcctcctgagtagctgggattacaggtgcccactaccaggctcggctaatttttttttgtatgtttagtagtgacggggtttcaccatgttggccaggctggtctcgaactcctgacctcaagtgatctgcctgccttggcctcccaaagtgctgggattacaggtgtgagccaccgcgcccagcccagcatttgttactctaaacattctggaaatcgtttgtaaggatttactctcccagtagtttcggtgttctggaagttacggccttggcagaggtccccgtgatagaagccaaggaaccatggcttgttcattgtgtgctagctgtgttgggttggcttgtttgctgggaagaaaagatttaaaatcacacttaattcaggctttaattataccactaacatacacagagaaaaaatgatgtgctgtgttggcagtggtttgtaagattatggacaactacgttaccccttcttgagtttttaaaatgatacaatactgggccaggcacagtggctcatacctgtaatcccagcagctcgagaggccaaagtgggaggatctcctgagcccaggaatccaggtcacagtgagctatgatagagccactgcactccagcctgggtgacaagcaagaccctgtttcaaaaaaaaattatgagataaaacatcctggaaaataatgtagatattgtagcagcaccattcagtagggtggaagctcccactcagggccctcacacctaacccgtgagcacagttagtggtctggtgtacatctttctgggtcttctgtccctttttaaattaaggatttacacatttacatgttaatgatttttttattaaattctttcagcgggcgtggtggctcacgcctgtaatcccagcactttgggaggctaaggtggatggatcacctgagctcaggagttcaagaccagcctggctaacatggtgaaaccctgtctctactaaaaatataaaaattagctgggcgtggtggcgcgtgcctgtaatcccagctactcgggaggctgaggcgttagaatcacttgaacctgggaggcggaggttgcagtgagccgagatctcaccactgcactccagyctgggtgacagagtgaggctctgcctcaaaaaccaaaacaatgttttcgcataataacatatccaagtacttgaaaggtactagaggtgtctgcggagtctagggaggcgccatcttctcttctcgctgcttgtctcctggcccctggagcaccaggtcctctgcactgctgagtgtgtgcttgtcctgcccattgccctgctcgggtttctgtgactgcgtaactggctgccccatgcaggrtgtttyccaaagtaccgctgtctgtggtctgtgtgctccgtcatccagcagggcctgaggtggcaaggccggccgggctggtggggcggtcctcagagttccccacgctgctggctgcccaagtccctgcctgaggccctgccctgttgtggcgctcatgcacctgcccgcrtgtcctgtgctttagctgaggggccgaggccctgccctgccatggcgcccgtgcatctgcccgcgtgtcctgtgctttagctgggaggccgaggccctgccctgccgtggcgcccatgcacctgcccgcgtgtcctgtgctttagctgaggggccgaggccctgccctgccgtggcgcccatgcacctgcccgcrtgtcctgtgctttagctgaggggctgaggccctgccctgccatggcgcccgtgcatctgcccgcgtgtcctgtgctttagctgaggggcaccttgggccctgtcagggtgttttcagttctaaagtgtgatcctcatgactgggtttaaattcttccaggtcaggagaatgaattgatgaggtgggggtgctttcagcttcttagtgggaacccctcccttttcccccctgttcatcagaagccacccaggcaccttggcctgctgagcggccactccctcctgcctgccctccgcgcccctcttgaatggtgggagtcctttcccattgtgcagccctgcaggtggaaactcagccggcagcccagtgctgcctcctgcatgttctcttggcttccatgagcgtggccacgtgaggcctcccagagtgccgccaagatggccccgtcatgcccagttagtggcctcaggttaggcctgtttctgtgtcatcccgaaggcagtccagggctccttacgcctgtatctcygccacctcccactcgcatcgtgggtccacggggccgggccaccaggggctctgccagacaccctcgcccgccacagccatctggaggattctgcccccgatgcccctgccagtggttgtgggtcctcaacccaagaacccttccgttgagcggcttctagaatcagtgccccttggttctgggaattcacaccacagtgacacagcagcttctcctgctgctaagtgtccttgccctgcagtgggcgcacctgggattctgtggtcctggccacggccactcgtgtggtcttgcagatggttcatgggcctcggtgggttacttggtaagtgagggtaatgtctgcctggcagcccctgaaggacgagatgatgtttttgctaatttctcttctgccacgtgcttctgcctgtccccccactccctcctgtcgctgtttcctccacagtggttggcaagacgtggcccctgtggcctctgcctcgtgcrtctgaaggacatcccagccacagcatcacatcagactggaacagtggcgggatggggctgggcatcaggcagcatgcatgtgtcatgtcacggacacctcagggacacacgaagtcaggcagggcgagggcctcactccccaggccgcctagcccttggtgggtatacccggccccgatggtgctgtgaagaaggggctgtgtgactggcatgggagggagctgcggcttttgttcatctctgccatcctggcagcgatgtggctgatgggtcaccttcagagagcctcctccataaatctgattccaagtgtgtgccccaaaccaacccagaccggcccggggcgtcctgcggagagccccacagtgggaggcccttgtagcggggagcccggtgactgctgggggtcagctgctggcggcccctgtggagacctsgcgacctgccaagggctccggacctgcctgggtggacccagggtgggcgtgcttctggctgcagggccgggccacaggcttccctctggctttctgccctcaggcctttagcattgacatgcacacgaccctgcctcctttmtaaggactgtgtagaattacgtggcattcagtgagcagctgcacgtggtgttctagggcacctttggatgctcaggtgctcctgaggggtgtgccagggaacgagtctcctacccttccctcctggctcctgttgctgcatccaggcaactactgtttccagtgctgaagtctctttccaggatgttctagacatatccaaactcgcacagagtttttgaatggtggtttcttaagagaaggggcagccgtgcgctgtctcaggatggttctgtcagggaggccatggctctggtttgtacagtgcttggtgcccgtagagtgcctggcagctcggcctcaacagctccagtgggtgggcagttgcaggcttttgctcttacagttgacctgacagtaacatgctgtttctcacatgtgcacaccattcttggggmaaattccaagagaatttctaggtcaaaggataaatgcttttttttgtttgagacagggtctcactctgtcactcaggctggagggcagtggtgcgatgttggctcaccaaaayctcaacttcctgggctcaagggatcctcctacctcagcctccctggtagctgggactacagggtccccgccaccatgcctggctagttttgttttgttttgttttgttttgttttttgagacagagtctcgctctgtcgcccaggctggagtacggtggtgcaatctcggctcactgcaacctccacctcctgggttcaagtgattctcccgcctcagcctcctgagtagccgggattacaggcgcccgtcatcacgcccggctaatgtctgtatttttaggagagacgggtttcaccatgttggctgagctggtctcgaactcctgacctcaggtaatccacctgtctkggcctcctgaagtgctgggatgacaggcgtgagccgccgcacctggccatcaatgcatttaattgtgaaggtgcttggagcgtccctccgctaggcggtgatgccatgcactactgcagccgcccctcagctgctttcccrccaccagcctccctcatggtgttgctgcttcatcttttcctcttgtttagtgatgtttttctttcattaagaatgaggctcgcacagctgggcttaactgaaaaaataaaaataaaaagaatgagtcacaggctgggcccagtggctcacacctgtaatcccagcactttgggaggccaaggcaggtggatctcttgagcccagaagttcaagaccagcctgtgccatataatgagaccccatttttacagaaaatttaaaaaatgagccaggcatggcggtgcgtgcccgtggtcccagtcccggaagcccttctgtctctttccctgtggcggcatcatccatgcacttagctggctggaaaccctcatggctgttgcccaagggcaggacagctagctggttcttgtcattttggtctgagctccctgggccaggagccctttgctgttttctctctgtttgtttgttttgttatctggcaccacaacaaactgccccaaaccatggagcctttcctttttttttttttttttttttttgagatggagtttttttgctcttatcgcccaggctggagtgcagtggcacaatctcggctcactgcaacttctgcctcctgggttcaagcgattctcgtgcctcaacctcctgagtagctgggattacagatgccagccaccacgctcgggtaattttttttttttttgtatttttagtagagagggagtgtcaccatgttggccaggctggtcttgaactcctgacctcaggtaatccacctgccttggcctcccaaagtgctgggattacaggcgtgagccaccgcacctggccaccatagtgcctttcaacaacgagcatttgctgtctgtgtttctggggtcaggagtcctggtgttttgtgaggtgcactcaaggagcagggtctggctgtgccctttgcagctcctcccctgactgttggcatgaggagctcaggagtgaaggtgaagaagggtactctgtgtctggggggtggtcagaggatagggatgaggacagggacagggcccaagaagatggggtgggtgctgtacctccctcttccttccctggggtatctgtgggccacggcagggcccacagctgttgctagtagcctscttggggccagtgggtttgatttatttttgtgtttgtgtggtttgagggcaggcatcccttccccaccctttgcgtccctgctacagtgacccctctttctgggtccacctgctctggcacgagcttggtgggccagcctcaccccagggcccaccccatctccagcctccctgccttgggcctggcagtcctgcctcttaattgcgttctgtgccacctgatgacccacgagttctgtctcctggcctggttcctactccctgggactttctgcagcccctgcccttccagctgttgactgtgtctgcgagccatcccactggaggggcgccctgggctgtgtgctccctgccctgcagcacccctgacacgggtgctcccagccctccactgaccagccagggaggaagctgcctcctgccggcctgtgcctcgcttcctgtcccctctccagcagcacacggcagcgcgggccgcgggctcaccggagcgaggactggttgcagggccttctctttatcgctggtgtctagtggatctgtggggtccgtgcgctcagagctgttttttcctttctgtgctcatttagattcatttttttcccagctttgcttggttttgtcttttcatttatgtgagtttttctttttattattttgtgcagaagtttctgtttttatcagtttaatctgcttgtcacagtcaagaatgtgagaaaagactggatgcggtgagccaaacctgtaatcccagcactttgggaggccaaggtgggcggatcacttgaggagttcgagaccagcccggccaacatggtgaaacctcatgtgaattgcttgagcctgggaggcggaagttagagtaagctgagatcatgccactgcctccatcctgggtgacagagtgagtgggactctgtcttgaaagaaaaaagcactagtaagagaaggcctaagacctagtattaaagtaagagaaggcctaagacctggtatgaaagtgagagaaggccaaagacctggtatkaaactgagggaaggccgaagacctggtattaaagtgagagaaggccaaagacctggtatgaaagtgagrgaaggccgaagacctggtattaaactgagggaaggcctaagacctggtattaaactgagagaaggccgaagacctggtattaaagtgagagaaggcctaagacctggtatgaaagtgagagaaggccgaagacctggtatgaaagtgagagaaggccgaagacctggtatgaaagtgagagaaggccgaagacctggtatgaaagtgagagaaggccgaagacctggtatgaaagtgagagaaggccgaagacctggtattaaagtgagagaaggccaaagacctggtattaaactgagagaaggcctaagacctggtatgaaagtgagagaaggccgaagacctggtattaaagtgatgattccagatttttttttttttctgagacaagagtctgtctgtcacccgggctggagtgcaatagcctgatctcagctcactgcagtctccaccccccagattcaagcagttctttctcctgcctcagcctcccgctgtgattacaggtgagcgccaccaagcccagctaattttttgtatttttagtagagacagggttttccatgtaggccagtctggtctcgaactcttaacctcaactgatcygcctgcctcggtctcccaaagtgctgggatgacaggtgtgagccactgggcccggccttcccagataatttaaggagagtttggcctgtgccggagcataatgcacactcttgggcaggggatcccgccagcgtctcagcgaaggctctgggaatggcaggtggcaggccgcgttgctgcagcgtgggaaccctgggctcgggccccctgtcgctgtggttctggggtctgggtgctggtgccgtctgctggagagtggtctggagctgcagctctgtggagtctgraaaggggctgcccagtgattctcaccagctrgtcagtggtggagaagttgcctgggtgtggaccacagagctggggatggaaccaggggccagggctggtggtaaactccgctcttgcctctgcctgtggccttgctttgggttcttttgaagactgccagctccaagcttcttggcccccatgggggagtcaggcagctgttctgccacctgccctgacactttgcagcatcaaacagatattttgtagcattctggattcgaggggtcagagttcaggccgaaagcagcagggtcagtacaccctgagtacagtgtcatgctgaggggccggggagccccagagggttctggtacattccacctgaggaagatcgacactcagctcacatcctgtgctctgggacttgggtgaggatctcaggtgagcacagccgggcctcttgtgtgtccagaccgcccctgacagccatgttcacgaagggtacccctgtccagctgtcccctctcccagggctcagggctgcaaggacgtggtctcctgtgccaggcagagccacacggccttcacgacctcagcccagaatcctgtggtgtcagtgtgggctgcctcccttgggtgggtaaagcagccacaagcccacccagatttgcggcgggggggacatagactctgtctcttgatgcgatgaaaatcaaaggtttgtggccgtgttttaaaatggtcacagtcacccttacgcttgccaaatagtctcttcccccagcgctccccagaacctcattccactgccagggtctcatctaaaccaggcctgatagatgggggtccttgggcccctctctgcacagctgtctgcagtggggcaccgagtcacagtgctgtggagtggtctctggtctgtggtggtcctaaggtggctgagcacatggctggtggtggtcttggccatggtggtcttggcccgtggtggtcttggggcctgtggtggtcgtggcccatggtggttgtggcctgtgatcgtcagggcccatggtggtataggggacctgtggcagttgtggcctgtggtgatcgtggggcccatggtggtcttagggcctgtggcggtcgtggcacgcagtggtcttggggcctgtccttgagacccatgatggtcttgagacccgtggtggtcgtggcctgtggtggtcttgaggcccatgggggtcatggcccatggcggtcgtggcccgtgacggtcatggcccttggtggtcatggcccgtggtggtcttggggcctctggtggcagcacacatggccagtgcctcatgcagggttggcctccatgcctgggaacgaccctgccactcttgggctcctgccccgagttaccttccttttccctgagtaaaaagggatgtttttcggctgtattttctctgggcttttcagttcctgctgatgtactttctttaaaacaaaatgtgggtttcctaggtacctgttgatgagtcgttgctgtcacacgagccatcggcacagagctcttggatagcagcctgtctctgtgctgggcaccctgcggctagcgtgggcagggccctagggagccttggccgtgctgaggtgcygggtgtggggtctgtggtgcagcgctgggttgtcttggtgtccttggcaccccgacagcgatgttctggctctggtctctgggcaagttaggactgcttccctcctgctgtccacgtctccagcagaaccctcttgtgggcagccctgggagcagagttctcttcccaccgaaccgggacaccgcagctctgtcgccatcctctcccaggaggtgagggcagagcccgtgtctcatgcctggttggtggcagtggggcacggcctggctggcctgatgctggggaggggaggctctggtgtggtcacaatagggggctcatgcgcttggacaccgtttctgtctggctgagcccactgtgggtttctccctttggtcctcatggtgacattctagccctggggctgggcagaggccacgcagggttcagggactacagcagcctttccttggccccagcggccccgcatcctgctggcacctcgtccttgcgctccccctcggcggctccctgcccacccgtcggtccttcagacccgcctgcctctgcccagtggcgctcgcccgcccactctctcagcttttacttcaccctcacgcaactctcgtgctccatcgggcccgacccctcctcagtcaggccacgcacactgcgggtggtgctggagaccctggagaatccgggctgactccaggcatgggcgtggcgggagggggtcctgtccccaggagtccggagcgtggcgtgggctcatgttccgttgtctgtgtcgttagggttttggtggccttttcctctaatttttaagttaaaaaaaatacgttcaatgccccacagcatctgcctccaaaatctgaaggggccttctaggtcaggcagttcccagcagtggccgcccctgcctgcaccgcccctgcctgcaccgcccctgcctgcaccgcccctgcctgcaccgcccctgcccgcaccgcccctgcccttcgggcgctgggcctggctgagcgctgtcgccccctggtggactctgtgccccacagctgtcccacggggatgctgcgcccctgggaacccagcacctycgaaggccacctctgccccctgcccagagcctgcctgtgccgtggcctgtccacatccagcacaggggccacggggcacagagcgctgggtgacaagtcttttgtcacctgccaggaccctgggactgcggcccatgagcagcgaggctgggactccagcgtgcggtgcttcagcccckgccactgtgagggktcgggagcccagcccggtacccgtccgcagaggccaggcgggggcagccgaccgcagccgggtgtggaactgcccttgtgcgcgtctggggcttggggccggggtcacggatctgctgcggctgtgggggctcatgtgctccaggcaggggcaagagctccgtgtcactgagcgccccaggccactgtcagcagcagggggagacgtggaaactgaatccttccttgttcctggcctgggaaaaaacttagtctcccatctctctttatattgaaggaaaaaacaggcaggggaggagcccgggccggagagaagaggggctcggggtgggggcgggggcgtgcccgccttcgctctggggttcctgcgcccgagcactttactgcccccacgggtgagaggtgggcctgttttccccatcagccttggttccrccagtaaacccgatccggttggagccatcctcacctccgcagtcgagggcagaatctgttttccaggttgggatgtgaattctcagtggcgcccactctgtgacccggcgggatggggtcagcctgggctgtggacgtggtgggtgggagaacgctgggcaggccttctgagtgttcggggccctctctgggccctctgctggctggactgggcgggacgtggcccccgggatgggtggacaatgtgtgtcccccgccccttcaagagcattggccccagtgaccctgctgcgacggctgcgtctccttcttccccccgaccatgctgcccccgtcccaggcggggctcggcaggagcgccatgtggggcccctgggaggagtcctgtggctttgacatgaatgggggtrcgggtggttggcggtgggtcttggtcctcagctggcggctttgctcctgactgccccagtggcttccgtgtctagcctgacacccgtgtcagcccagggacagaggccccgggaggctgcartccagccctcacagaggacagggccgtgggcaggacctgcggcgccgggtgccagccacagcccccagaggcccccttagagctgggtgttctcggccttgtgctgaggcctgtgccaggctggagctgctcagagatttcggggtggtgggcttcctgggatccccccaaggtcaaagggtaccctgtatcccctgaagtraccattttctctctctctctgcaggccagcactccttgcccgaggacagagatggcgagcgcccggattggggatgagtatgcggaggacagctctgatgaggaggtaggactggggctgcttcccactgggcagggtggggcggcttccatcacagcctagcaggtgctgggggttggggctggggttgccctgggggtgctgggacctgccgcaggtgggccgcactgttggagccgaggcccacgtgggcgtcctgcttccccatctgcaagagcaatttcggggtctgggacacaagactgcaatgtatgtgtgtcatcatggcttgtgaaggggaaggacctgggtgtggctccatgcccctgtgtctggcctgtggacgggctctgggggctcctgtggcgtctgcagggtggctgtgggctccctgggcgtggcgtgcatggtctgggtgggggtcatggtcggggtgggggtcacgggcatgggtggtgcccctgtcgtgtgtgctgtggggtgggccacaggttggctgggggccaggcgggcagaacagggccagggccacctcctaatgtcctgatgttctgggcagtggtggcccttcccttcccctggggtccccctgccccccacccctggtggtggctgatgtgggctggggccgttgcctctggacctctgactgagtcccaggagcacatctcaggaggggcaggaggtcggctgtttctcataaggagcttgcaggcgaagggggatgcgtgctgctgggctgggctccaccagcgtggagaggctggcaccgggctgggctccgccagcgtggagaggctggcaccgggctgggytccgccagcgtggagaggctggcaccgggctgggttccgccggcgtggagaggctggcactgggctgtgtccaagagcagatttggctgcggggggctgccctcatttgggaggggctggaagctctgagaagctctgaagccagaggcagtgcctgcctataccctcctcagtgtggcctggccccagggtaggactgtggtcccagtggagcacctgggtgtgaggcagagtctcctttgggccctgggggctgtgggggaaggagaaggctttggtgtagggccttcctgaaggagctcttcctgcctgcctgtcaggaactgtccccggggggcctgggggagacacgcgcccccctccccccaggttcttcccccatccttcggctctcttggctgtggctgcaggagccttggccgcccgcccgatccggtctctgctgcgcgttcagagaacagagacaaaacaaaataaattggtttcctggccggagcagcgggctcactcagagcgggggggccacgccgcgcactccctgcctgtctcccctccccctcccaggggctctggctgtcggcagccacatcctgtcggctacttttttatatttggtattttgagaaatcgatgatgattgtaaacggagcgcggaggccgggggaggggcctcggcggggcctgtgggaccctgctgcccctgggggtgctttgccaggcctgtccagtgccaccgccgcctgccgggtgggcagccccctgctgtgctgggaggaagccggccagggatgtgggggctgcttcctccagtgatgactatcccatatgttggtctgagtgacagcgagggagcccgggtgctgcccggtgctcctgccagcacagccggccagtggctcgagggggcggcagagctcagctttcaggagccaggccaggcccggacagatgcctcccgtccagagaagtgcgcatctgcctgggcctctgttcccttggagcaaagtggggtggccctaggggagtgatttggggccacaggtgggcaggaaagaggcttgggaggtgggagacagcctgcagctctcccatgagacagtggggtgaggagagcagggcccgtcaggcagccccgtgtccttggaggtggccgtggcaccaggaccatggtcctcctcggcactgggcagagctggctgagagagggccgacctcactgccggggcccttcagggctgtggagagggcccctggtagcagggcagggagggcgccgctggggcgtgtgctcctgcgagcggcgatctcagctggagcgcgtgggtggcagtggctgtgatgctgagaaggtctcgggccaagctcctgctggtgggaggtgcctccctgccaccccctgcccacctacctccccttctcctcaggccacttccctgcccttcctgggtctggatccagggcctggacctggatgacactggggcttcagggaccccctgctggacgctgacttttgaagacctgagcagcccctcacaggagagctgtactccagctcttggtgtcttattcccctcccccaggtgcgcaggcagcagcgagcaggcggagggaggcgggcggagcccctggaggaggcgctgggcctggctggggtcctgccgccggcagtggggggcccccaggagccggctgagctgcggctgccccgcccccgcatggccacctcacccctctcccaccgcgcctggagcttcacagacgtgatctcatccagccgctgggacccccggggaggtgggccggggtggaggggcggggcaagggggctctcggcctttgccgaagcagcccctccgctttgatttgagcggttgggagaaactgaggccgggtggctgctcaggcagaggatgcagccacccaccctccccctgcctgtggccgtgtttgtcaggaaagcgtagcaggctgagggatctgggtggccgtccactctggccggaggagccgccctctgctgtccctttcctgtgccccgtggtgctggcctggggccgtcccccacgaggcctccactggggcctggagtctggggctgggtctggggtgcagcctggcagctcctcggtgcccctgaccctgcctgggctgtgagtcaggttcccgcagggatgcagccgggcctgtctgcgtccagagcccgtggtcccctctgctctcgcgccaagcgccgttaatggcttctcccagctactgaaccggcagctgcctccagtgctggcggcctccgctcctccgggccgcccccgcccccgcgtcctggccccgcgcactcaggcttgcgtcgctgctggcggcgcggcctcggctcaggtttcccggcgagcgaacggccctccccacgctgcttgtggagggcgcccgggcctgcagaccgccccaatctccctggcggccatccacccccgcggcctcctgcatgcctgcctccgagggggctgctgactgggctggggctggccctcgggtctggtccctttccactgaggagggaaacgggcgcgccctgctacccaggctgtgggtgggtgtgtgtagcctgactgccgcgtgccccttggccggcttgaaggccctcctaggcctggcctgctgcactcagttgtccggtttgggagaggagagaccctggggtcagtgatgaggggcagggaagccagggccctcatgggggtaccctgggctctcggatgaagcagggctgggcagtggctggtaggtgggagtggcctcttcagagccgcgtcctcctgcttgtgggctgcaagggtggtgggggccctggcctgctgtgcccactcggggccagtgtccttggcagctggaacccgggtgggcagcggggggtgctctacagggctcttgagcggaggctttgccctggggctggcagagcagcctgtggagtggagccggggaaggcattggagggcaaggtctgttgggcaggtggtgacggctgcaggctctgggccctctggggaggccggctggggagagctgggtctgggtgtacgtcccaaggccggggctgttctgcaggggacgggagtcccaggtacgtgtgtgtgcacggatcaggactgggggaaaagtctccagaatgagattttggaggtgtccggagttgggggctgagcgggtgtggacctctagagccctgtccccaccccacctggaagttgtagctctgagttgtggggctcagagcaggccgaggaggggtgagcactggtgggtgtcggtggggggtgtttggggtgtcatgccccaagcctgtgccccacccccagcatcctggtttctgggagcccctgcttatgagatgccaggcgttggggtgctctgcctgggaacagctattgtccctgggtcagccccagcagagaccgaggcaggccaggtctggaggaacccctgggtcggtagtggcttctctccagcctgcagacccccaggaggtgacttgctgccctcccagctgtggaggtgcaaggacccctgggtcagtagtggcttctctccagtggtggaggtgccgggagaaggccgagctgtgtgcccagcctctagaagggcagatgcgtggttggcgggagccgggccggagctgagggcgtctgggctggtggctcctcctgcctggggccccaccttgggctgggggttcgctcagctggtttggactttgaggaggaggagactaagcaggacctggctttctcccctctggccccggcgccrgggcccagcacccctgctggaaccttcagtagggtgagatgcagcaggtgagcctcccgccctggccttgccctgagcacttcaacagataaaaccctgaggaagaggaggcggcctcacgtcgcacaggaaggccgtgtggcgctccgagacaggcgggcgttttgtgcaggggagcggcgcgaacgctgaacactacccgcattgtaatcggagaggggctggggaagagagagacggagcgagggcggctgaccccacgctcccgggggacaggtgggagaggcggaacgaggagagagtgaaggattccagaggtgggccggcttcctctctcgcagacagacacgggaggaggcgggcagcgggccagccccatacctgcagttccaatctgtggtcctgacagctgcagccactttggggagggggagggaarggggctcatcgagagcggaaaaatcccagccgacacatcagccggttgcggcctgtgtccggtgcagtctgggctgggggcctgtccttggggctgggcggcccccaggagagccctgatgctgggtctgtgtgtgcccccggccggccggccggggctctccgtgcggggcctgacccggaggggtcacatgtgtttcctggcagcccgcaggtgctgcgctgggcggggcgggtggtgggcgcaggcgaccgtgatgaatcatgtgtcccgccagcagctcgttccccaggccggggacaggagctgacagctgaggcccagcagagcgtttccagcccagctcggctcgcaggggcggctgctggcccaaggtgcaggctggggccccttccgtcccagctgcctctgtggggcacaggcggagggagccctgggtctctgtggaggtgaggccagcactctgggaagggagccaggggctgtggtgggcagggagcacctgccactcgtctgcccggcggctgtgagctacgagtggattcgggtgggctgccgcaggcctgggggtcagcccacgccacccccggtctggtttgaatttctggagcagtggagggtgacggagtgttcctcccccgcccctcccctcttgctggctggcgggccgggccctcggccgctgctaccggtgcagctcagggagcggctgggctggctgcccaggcctgaggctggccaagctgcagccgcggtcggagtcaggcccgcagcggagggcttggctgtgagtgctgcaccccaaccagcagggccctggggatcctttcagctccgaggcctccaggtcgttgttccctgttcactttcttctagcctcgttagacaccccaaactctgaccccagtccacgggggctctgacrtctctttcccctgcactccctcttgaccctgcccagacctccccatgctggcccgcaccttcccacctgctcctgtctggcctcctgcattcccgctctgagctggctctgccctgtccttggtgccggccgccgacgccccgcacctgcccgctcaggccagcagcccctgatgtccctgccctggagactttcactatcttccatcccatttgtccccaacgttgacyggccactgaggttgggggttcatgtggaggtttgcaacccccactaggcccaggtctggaaatgggaggcctggaggtgaggggtaggtgggctatggaccctccctacagaactacacccagtgcccagtggagggagggctggcgtgggcgccgtgggccttagggtgctatgcagagtgcccggcctggccatgctcctgggtccaccctgctcctcactcaccagcgccttggtgcctgggagggtggcggggcgggggtgtgaggaaagctcccaagaagggaaggggctgcgtcagcccctagctgcatgtccgtgtcccccgggccctggcttcccggcgggcggaggcttctgcagtgactgagcttgtcctctcctcccctccctctggccagctgtgggctcctgcaggattagggagaggaaatttggggttgggtttctctctgaacgaaacctgccgttgtgactttttatcctgttatatttctatcagattggactcagcccccctctagcccttaatggctctggctttgagaatttcctccaaaattacaccactgcttcctgctccgccattccctggagcctgtctttgcagaggaggggcagtcctgggccagccctgcaccgatgcccacgtgggccacagcacctggtctccccccgagggtgcgtccctgcctgtgctagcggggaactggggccggccgccgccctgacgcccgcacctggcaccatcagccattgtccacccagccggaagttaggctgtggcctggcagggttggggggaggtggtccacacagcaccgcccttcttctctctgtgcccactgatctcacaccactcaatggtaattgtcacctgcagggttttaatggccagccagctgtgcacagagcactgtgggggctaaacccacctcctgtggtgggcggggtcttcagggggctggatgggccgtggtggtgggaggaggatggccaggggtcctccttcccacgtgggcagtgcttccaggggccaagtggcactggtgcatgaggagatgcccctctctccagtcaaggctcgtggaggcaggacacccactgccctcgctggggctgggagccccccctccgctgggcagcacagctcgctccactccttgtggccacctgcagcgccctcctcaccctcagggcccccgggtgcccgacaggcccgagtcgggggcacccttgccctgctgctgcctctgtccctgccgctgcctccctgtccctgccttacagcgtccctgccttgtgcctcgccctccccatcttctgccacgcagctcctcccccaccctctctcccggcgtggctcccttgtccccaccccacagcttcccgatatgaggctctgtgggtgagctaagcccatcctcaccgcctcagcccagggaggggtggccctgagcctggaaagtgggggcttcccagggagccggggtacttggcccaaggaggatgggaccaccaagggtgggaatggaggctcaggctgggggctgggggtggattctgaacctttcatgaggacagttggcctccatatttggaagatactgttttgtttttaattatacaaaattttcagactttatattatcatatcaaaaacacaagatgccatcacacagtggccggaagaaaagccagcgcagaaagttccagtgggcccgggcaggtgctggggccagcgcagagtcccgctgccggcgcctgtctgtacgtccgtctgtccctcggccccgctcgcagccagggctggcctgggggcatgcttgcggtgggccttgcccagctcaggtccaaggtgggggctgtctgcagtcaccccgggcgtccacctcccccagcagcgtctgcctcctggctgctgccggccacctcctaactgcgaatcgctgtctttctgtcgcggtccttgctctgcagaggggagggaggagtgtcaggccccggcagagcccagcgccagtctgcgcctctctggcctccctgctgggtgccatctcargtggccagcgccaaggcacctccttcccggctctccccagcttccctcaagcgttttggggaggggagcatactgctgcacagccgaaattgtaaaattaaatttcccagatgttcaggccccaggagctcgcgcgtgctgtctggagaggaaatggggattgggaaaagccgtgccgtattttctccctgctcaccctgcttttccggtgccaccaagcacagcaggagctgtaaatcacagctggccagcgtctcctgcaggggccctcacccccagcccccacatctcctgccagcctctgccttcgtgtcccatggcccacgtctcgggcagccctacaggacctggtgtcttggtgtgcggcctaggtgggggacggacagcaggtgcccaagatggcttaagccagtgctgggccgcaggggctaagaacccggggtccttcctctcttgccttgcagcctcttactttctgaactcagctgttttcactccgcctttcaacttactgaaaagggaagcttgcagcggcctggtccagctccccagcctccccgccctgggtgggcccctttggccatccctagctcttacccctcatgcagctccctgcaggggactccacactccactgggagccgagtgtcctagggacgccctsgagaggagccccaggagaaggccccagcccccggcaggcctgtgttacaggtgtgcctgcctgtgccctgttggggagccctgcccgtgtggcctcgcctcctctgcctggcaggtgtgggctgaggggcgcgttggaggcccccctcggcgccccacggcccgtgctcaccaactttctctggttgctgaggcagaaggtgcagatctgtttgggctgggtgttctcgccgtcgcgggcgggaggcggcgggggcggcggcggggggctgccggcgcgcgccgcgtggaagaaggcgggcccggagtggcagggctgtccgtcgccgcaggcctcgcccgccagcagcacgttgcccaggtgcgagatgtagctggaggccaggcgcagcgtctcaatcttggagagcttgcggtcggcgggctcggtggggatcagcgtgcgcagcgccgtgaaggccgtgttcacgctgttggtgcggtctcgctcgcgcgcgttcgccgtgtgccgctgccggggctcacggcctggccggccccctggccccccgcccccggcccgccggccccccgccctgccgccgggcgccctggaggccgcagcgcgccgcgtgcacgcgacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcacatgtgcgtcccgggccggacggggccccgactgcgcctttatagcggcgtcccggcccctcccccgcgcacgccccgcccctctcagcccgggaggctcctcgagcagcgcccgccgcgtccctcggccttctgtggccacgctttggcgggggtggggggggcggggctggtctttggggrcatcgttccgtctctggggatgcggaggaactgggaggtcgcttctgggctgtagttactcagggccccaaaactgcagtgccccccgtccccgggagaggggaggaacccaccaccccgttttctcccgtggcacaactgagttaacccagccgccctggccctgctgcctgaccgcaccctgtctgtctttgcctcccatgtgcgccagcgcctgcctgtgccaggccgtgtgcagggggcgggcacaggcgagtatttaggggcctagagctcagtctctccgcctgtctgtcctgcacctgcctctccaggcttggcacagactgtgccttctgctagctggccatgtcccctgttcttgtgctgtgtggacctctcaccccgtcggtctccttgccccttcctccttcccccgttcctctccagggccaccaggcccctcaggaagcacacacatacccccattatccaatttggggatggccccctatctccatggggaggagagggaaggaccctcagcagggggcagggcccaaggggtccctcctgcagcagggggcccggcaggctcccagctgtgctctgtcttgcctgggcccctccccgtggctactgttgcaggaagcagcctcctgggcagcggtccccaggctggaaggagcgagggtggcggctggcaggggctgcaaccaggaatgtacgtccaggaacgtggctgttctgcctggggaggggccgagggcagacggtggggggtcccccacagagaggtcttggcttctgcctctctgtggaatgggtcagttggggtcttccccgagtccccgtcttatagctgcccacttctgcctaaggcccctgccaggggagggagcccgtgggtgatgaggtcatccctgtctgtggctgcccagagccctggccaaggaatccagtgaggggggagctctggggttggcaccacttcagtggaaaatgtgaaggtgcagctccggcgcctccgagggcgggggtgggggcagcgtggccgccatgccacgtcagaccccagggctggggaacaggcgtaggtcagggccagtgacctcagggcacttgaggctgggcctgcactccccctgcaaccccctcacctgctcccctgggcggcccgaagcgggggtgggccttgtaggatcagatgccgacatggtggcccccggctgcaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggtgagggctggtggggtggggccagcagccggggtgggcccgaggggtggggcagggctggcggggtctgactggcggtctccaggcgcaccgtgcaggacccgatgacagggcgggacctgagactgacggatgagcaggtggccctggtgcggcggctgcagagtggccagtttggggatgtgggcttcaacccctatgaggtaggtggcaggggctggcccctgggcggcgggggtcctggaggcaccagcagggcctcagccactctggcccacacgcccacatcttctcccccagccggctgtcgacttcttcagcggggacgtcatgatccacccggtgaccaaccgcccggccgacaagcgcagcttcatcccctccctggtggagaaggagaaggtggggcacacagcccctggggcttggcctgggctgaccgccccgcactgcccgtcctgacccggctgtctatgcaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggaggtgggcctgcatcctgggggccgggaccctgtccccatgcttccctgtgaccctccccacccctgtgtcttggtctccacagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgtgtgggggtggcacaccaggggggtggcacagggggcaaggctgacctggcgctctcctgccccaggtgaatgtagaccctgaggacctcatccccaagctgcctcggccgagggacctgcagcccttccccacgtgccaggccctggtaagtggagactagggggctggggttgcaccctcccagtctgactcctcactgccgccgcctcctcaggtctacaggggccacagtgaccttgtccggtgcctcagtgtctctcctgggggccagtggctggtttcaggtgggtcygagctgggggcagccttgagctggggggcaggtgggatggccaggtgttgagagctgtctctgccgcatccaggctctgacgacggctccctgcggctctgggaggtggccactgcccgctgtgtgaggactgttcccgtggggggcgtggtgaagagtgtggcctggaaccccagccccgctgtctgcctggtggctgcagccgtgtaagtggaggccctgggggctggggagccaggggtggcactgtgcttaggggccgtgtctgggcctggctcacagggaggactcggtgctgctgctgaacccrgctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaaggtacgtggggcgccttgggggtgaggctgcagcgggaggggccyggctcagccactcagccagccttgctctcctgcagccagtgacgcaggtgacctggcacgggcgtggggactacctggccgtggtgctggccacccaaggccacacccaggtgctgattcaccagctgagccgtcgccgcagccagagtccgttccgccrcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgaggggtgggggcggtgcaccctgcaggtgaggggtgggggggnnnnnnnnnnnnnnnnnnnnnnnnnnnnnnnnnnnnnnnnnnnnnnnnnnnnnnnnnnnnnnnnnnnnnnnnnnnnnnnnnnacctgcatcacagcctttggccctaggtgacaacgtcatctgtgggagctacgatagcaagctggtgtggtttgacctggtatctttccaccaagccatacaggatgctgaggtgaggaaagctgggggtggaggcggccagcagagcccctcccttcagcccgagcctgccttcaacctggttccctccccccagacaccacaagaaggctctgcgggctgtggccttccacccgcggtacccactcttygcgtcaggctcggacgacggcagtgtcatcgtctgccatggcatggtgtacaagtgagtgctgaccctgcctggccccctccccagggcagtggtgtctggccgtgccctgagccctcctcgtccccacagtgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgctgcctggtgctcccaccttcttgaattggggttgccaacaaagccgcccccaccacagcgccgagccttcccctcactcaattttgcaaaaacagtggggacaacacagccagtccagggcaccctctggcccatcccctaagaggctcagcatcgcaccctgtcagtcactcgctgggagcagatgagtttattgggcacatccctcactgaagggcttgggtttggtccccagcagtgcctgttctggggccaggcccctccagtcgtgtgcccaggctgtggtcctcaggaggccctgtcttggagctcaggcacaggtctgggtgcatactcctcgctgggggtgctggccggagccttaggcgagcttcaccaggcggcccagggcctcagcagccctcgtccgcacctcgggggccgggtccttcagcaggatctggagcgctgggggtagaggaggggggctgcctgcgggctgtgacctcggcatgcccatgcctgcgcgtgggccacgctctcctgacagcctctgctgggaggctcaggagccaacggaaagatcgtttttccttttttagtgttttttaagctctcttggaacagttaagaagtttccgtgaattactagagacgatgaggtcaccagtgacagggaaaaagtcctgaaatccaggaaaatcacttagtccctgcgggtgcctacagggtcagcagggcccagcggaggggccccgtggaggggtgctcacccgcaatgagctggtccaggtccacctgcggctgctgcctgggctccgagtgcagcaccaggaaccctgtgaagtgggggcatcaggcggggctgccgggcggcgtgggggtggggcagggggtggtgcttaccggtgaacaggggtgcagcagctcggacgttctcccagctgctcttgaagtagaacaggcaggtggtcaggagacggcccagcaggtctgggaaatggtgcatctggggagaggcctggtcagtgccgcctggccccgccccacccaccacgccccgcctggccccacccctcaccaggtgcttgcaggtggtgttgaggaactccccgaagtgcagggctcggccctcctgcaggtgtttctggaaagcagctgagagctcctcacatgccagattggggccacacatgcgcagggcaaacctgcaggcctaagggatgcggcactggggccaagtccagttgaggccacccaccccatcccactcaccccctggctactcacgctggccacagtggcctgagggtcctgcaggtgcagcagcaggggcgccagcccgcccaccacctggtccaggaagacgtcctcacagtctccgtggcagaccttgttaaggtgcccaaagaggcggatagatgccgtccggaactccatcttctcctgggaaggacatgcagcatacgtctcctcacaggctgtgcccctgcaggcctgcctgcctagccccctgccattgatgggtgcccttgcctgacccgggccaggaaacaccccgacgggtgggggccttacgggtgggggctgccaggcccagcaaagcagcagccctgcaggtccgcgctctccacggtcacctagccgaggtgggagacagggaggagggtggggctggggctaaagctcagagtaagaggcaggaagggctggggccctcttccctccccctgccccaaccagcctacactgtcgaagaaaggccggatgcggatggccacgtgcagcagccctgagcgcaggtcccaggactccaccaggtgcaccagcctcgcaaggcccagcatggcctccagggccactgggctgtgagggttgtccccgtcgtccagcccgccaatcatggctgtgaggagctgggggccgtgggttcgcacctgaggataccttacactcagcctgggtcccagagtcaccgtctgctaccccacaagacagggtggcctccatgcacagccccccacccatgctgcctgggacccagaggggctggtggccaccccaccttgtcagggcagccggaggccaggttggccaggccgcggagcaccagcctccgcacgctggcgcatgtgtccttctggcgagccgccaggctctccagcagcgagtccaagagcatgaggtcgttggccacgttgctgttcagcagctgcaggcagaggtgctgtgacttccctctccccgctgaccccagggctcaacccaccagcccaggcccagaacaccagaggctgtccccacgccggtgtggcagacagaggtggagcacctactccctgggtctccgatcagtggcgacccctccctgttgtgccactggggcctgctctgacgcccgctgtgctctgctgcacggccttgggcaagattttggcatctttggccacgaaggccaagaccacaccaccaagggcacctggggtcccaggggccagccctgtccagctacaaatgtacccagcaggacttggggagagtacaggctgcagggagcctcggtcctcctctcaccaggcacagagggggtgtccctgggtgggactgagtgagttctggcatgggggaggaggtagctagcatccacataacctccctcacagaccacggtcgagggggccttttaggggtaagaaaagggcatcccgtgcctgtcctgagcaggagccccaccttggtgcccagcatccgtccctggaagggcctacctcggccaggaaggcggtggtggtcaccctctggttctcatacgcactgctgtgtgtgcatgccagcgtcttcagcaccagggggagtcggggccctgcgtgctcagccatggccctgggaaagggggccgctgagggtgcaggggctgttgctgtgctgaaccctacccaggcaccttccaccctgcacagccctggtccgctccaccgccagctgccaggttctgggagttctatgtttcagagatgcctcccagcttgcctcgccaggcctctgcaggggtgcctccctacccctgccccagagagtgaacaggcaggagcccagggcaccattggcctgacacgcatgggcccccgcctgatcctgtcatgttctgggctcgagatccggtggagcccagccagtgctggagctgcagtgggctgggcccgctcacctggccaacctggtggccccctcctcatgccccgccgaggtcctgagcagttcccagcctccctccaggtccatgcgctgtaccacatcctcgctgccgctgcggagtagcatggaccgcagggtgtccactgcagagctgcaggattgccagggtgctcagctggtagggcacacacgcctacctcccttcctgattaactcctcaggtctgcacccaatgcgtgttgcccacctggtggctagccctatccctgccagagccactctccaggaagcaggctctgggccatctgctagaggccccccatttccccacccaaggcaaggacgcagatgttggcttggaggtgagctagtagcaaggtcagcctgtggccacctggccaccagcctgagagctggacacaggcaaagccctctggctgcaccggccttcctttccggacacccagacgctgctgggcacccacaccacaggtgccccccaccccgggcctgttcctgcctggcacctcgggttctcacacctgtaccccaggagactccacagccctctgggaggcgagcaggcccctgatccactcccagtgtcggctgaggctggctggcaagtgagcgggaggatggtgccgagagctggaggggctgctggcgtgctgaagagcaggcgccctgggcgtgcaatgggggccaccttggccaactctctgactccccagacctccaccaggcaagcaccttgccctctggtctccctggcagtggctgggccagaaactggcagggagagtctgatgttgaagcctctacagggcccagcttgagcctggcatcgaccatcggctcagatgagcccttccctgctgaggctgctccactcctggctgccagtgggtggggcgtagtgtgtgacccaacaggcacggtctggggcagaggatgccctgcaccagcgtccccacccagcaggaccctccatttcaactccacagcccctgccatgtggctttccgctgccctcgagcacctcacacttaggcccccgccgcctttggacctctgtccccacaaggcttcgtcctcaggagcacctggcccaaaagcagacaacccccgagcggcatgggccgtgtggtgaccgctggtggtggtgacagtgccactgccctggtcacctcctgccaggtgtcccacagggcccctggtgtgctgcgacgtggagtgggcctagcagggaacaagtggccccgccaagctgggggccaggccctactcgcctggatggtgtgtgaggccctcatgcaggtgggatctaggaggagggtgtggtgggcacaggagcatgagacaagcttgttagagatctggtgatgggccccatgaggcttctggacggttgggtacacagggctggtgatgccggcaggaatgaggcggcctgagagctggacaggggctgtaggagctgagggccacgggggtctcggcagcccaggaaggaggtgctgggggcctgctcccagtataccactgtccccatggggtgtgcctgggtggtctggtgctgaccaacagcagggccagcccctcacacagcccttgatgagtgtccccaggctcctctctctcacgggttccctccccaaggtcggacgtacgagaaggcagctctggaaaagcctggagtcccatggttccagtgttggggcctgatctttgagcccaggtagcctgggtgccaagggggcttccagccctgggaacaggacagccagcactgaccacaggcagaggacagagccacaccagtcactgcagttcctgggagatgcccttgacacatacaggccaggccagccgcaggcggagggaggacccaccgggccacagtcagttcagctgggcctcgtggtctgagccagggcctcatggtctgagccagggcccagcttgagtgcagctctgcctccagctccacaccctgctccaggcctcgagccctgcaaggccccatctggaccaggggctgcgctccaggctgcaaatggcgcaggcacagcaactcacaaccagcatcgacaaatctaacgggaagcgtgtgtttggctcacgaatgtgttagtgatttggatgagggtgcctcccttgtttgtgtgcccaggacatttaagaatgtggcacccacaagggtccgacccactggcgaacggcctgtacaccaggctctgcaatcgtcccagtgaaggggcacctgggggtgggcgtggggcccgcagccctacagctcggggcggaggcactgattcgcagcaggccaggcccaggggctggtggctgccccatcccattcacattttccactcagtttgctaggggcagagcagcgctggcagccggccccactgggctttacgagctggcctgggtctgagcagcctgtggtgctggggcagggggagggggctgaagtgcggctgtccccctggtgtgtcctggccaaggggggcagggggaggggctgaagtgcggctgtccccctggtgtgtcctggccaaggtgcacacccaaacctgggcgcctgggtgggatggaaccatagccctcctgggcaggtggggcatggcagccctgcgttcacatgggcttgtggtcctggggtcaggccacacagccacgcctgcccagggtgtcagcctcctctgtctgtgctatggccccaggcaggtgtgtaggacctggaatgcttcatgtcaggcacctgggcagctcttacgtgtggggctgtgaacacgtgccaaaggccgctctgctggggcagtttcagggacaaagctggtcctgccatggttgaccccagcctataccccaaagactccacacaactccactcccaggagaaggcaccacccggatcctgcctgagctgccacacgaagcccccaccagctgcctgtgttcagcaccaccgtgcagaccgcccgcagaggcgaggagggaggccttcacagccagtgtgagaagggtggccatggatgtcaccactgacagctcagccctgcacctgggtgaggcgccagctccctggaagca

SEQ ID NO: 12446 - DNA, 20285 bp, Homo sapiens
tggccaggctggtctcaaattcctgatctcaagggatctacccaccttggcctcccaaagtactgggattacaggcgtgagccaccgcacccagcccaattctaatttaataaatctttaatatctaatgtgcactttcctctcatagtctctttcttaccaagcaatttagagattaaggaagcttaattaaaagaaatttaaattagaccctagctaacttttttataattccaaaatgatatttatgttccacctccaaacgagaaattacggatgatcaaaacaataaagtcgattcagagagagcaaaatagtaataaactgtaagtataagaatttgcaaaccaaagaagaaagcaaatgacactctaccctttaaaaaaaaaaatcacaccatatagcttttggatagtgtttttctgttttgttttggtttttaattaactctgaagtcacttccaccatatcacttaaatcattattatctcaaatgttaaatgtatgttattcaataaaattacaagatatcttttatctaatttattatgttttgtttcctaccttttcaatgtcataaatttaagaaaagttacaataactataatctctacccaccccactcccccactcctaaaacgacctgctgcaacggccagccatgccttctcatcctaccttcgcatctgcttcaagagaagagaccagagccggctctgcagagaaggaagtcaattcttcttgttagagtaactgacgtatttctcttcccttcctgtcgggcacaggctgacgcagtgcaccctgtgtggccagccttacatgcctcggtggctactcccacatcactagggacccagggagcaaagccaccccaaaaccacatcaaggagctcttctatgccaacattttacatttttagctggaggaaagaccaggctgatgctggtgaaatgtttcacccttcctaaggaaactccctacagagactacagccttcaaatattcaaatgttctcacatttgtgaagggtttcacattgacttcagtgtaaatgactaaccacatctcaaagaacagctattaactcaagaataatttacaagaaagggggacagccaggccaagagcgatgaagattgtaatgaaatcaccaaggggaaccttcaaaatgctgtgcgtgtactaggtagtattactcagcaccgtgaagtgtccctgccctgctaactcaggcatggccaaggacttgctctggagagcaataagacaatgaagtgtgtgcaaaggtgccacgtgccacgtaggcttggcacctaccgagccagtactggggccaccattcattctctttcccttctctttcccttgatgactccagacacaggctgctccagcaacctcgtctcagcatggagaagacatgaagcagagccatggaagatccttgatggtcatggagtgtgagtggcaaataaatgtttgctgtcatcaaccactgagagtgtagggccatttgtttctgcagctaacctagcctattctgctgatgtagtgtgtagtgttttcacaaacacagaactgagcaccaaactatttaataactactatagcatgaatatttacccattggaacaaatgccagcggaggccctgctataccacgagttatcctttagttattggatcttggggatgaggtcccagggaaggggctgcagtcaccaggattgagaggaagagggacccaagaagctcagagcagccactgtttcatggggtacagaggtatttcagcacaactgtgcctccgcttcccagctcaatagcagatctaaatataggcacttcttagctaatctctttagcttttctcagcacaggactctcactttagatatgtgtcagccagagtttcttttcctttacaacattaaattcctcagccatgagtgtttcaacagcaccctcgtcctcatcgtcttcttctgttactattattttgactcagcatgatctcatagtaacacacttcttggcacaggggaagaaaggaaaaaatggaaaatccacaggatggcatttggactatgaagggctgcagattatagcagaacaacactgctggatattattattattattatttttttttttttttttttgagaccgagtctcgctctttcacccagtcgggactgcagtggcgcgatctcggctcactgcaagctccgcctcccgggttcacgctattctcctgcctcagcctcccgagtagctgggactacaggcgcccaccaccgcacccagctaattttttgtatttttagtagatacagggtttcaccgtgttagccaggatggtctcgatctcctgacctcgtgatccgcccgcctcggcctcccaaagtgctgggattacaggcgtgagccaccacgcctggcctattattttattttttgagacggagtttcgctcttgttacccgggctggagtgcaatggcgctatctcagctcaccgcaatctctgcctcctgggttcaagcgattctcctgcctcagcctcccaagtagctgggattacaagcatgcaccaccatgcctggctaattttgtatttttagtagagatagggtttctccatgttggtcaggctagtctcgaactcccgacctctggtgatctgcccacctcagcctcccaaagtactgggattacaggtgtgagccactgcgcccagccactgctggatattattgatgttatttattgatgtgacagttcattgattgctatgattattaggcccacacttgctaaataaaggtattggcagctccagtcccacagtctgtattcaagaaatttgactccagaaaagaaaggtgattgcacgcaaacctgccaacctatcactaacctccaaattgaaaaacaaacctaagattcactccactgacttactgcatagaaactaaacattattctaaaatatggcagaatgccaaagattcatgagcagttacgagtaaaggtgtctgagctccaatgcttctgatggacatccattcgtggcagatggaaggtgctggaaatggcatctggtgaactgccaaatgtcttaacgattttaaattccttagccctacagactacatcagttgggcagaatataataccacatcactgcatttttccaagcactacaacatcacataagcctagagaattcaaaccctcctatttacagatatatccgtttaaaagaaaaaattccataaaggccatgttttagtcaactttgtagcctcaacccccagctcagagcctgacacaaagggagtgctccatatatgtgtattgaacaagtgaacagatagttgtgaagataaacagaccagctcatccgtttactggcagcctcaaaatgtcatacatcgcgatcatttaacaaatgttctttaatagttaaaattggagagtggtacccaatgtataaaagctaaaatcatgtaagcatttttaaaatgcacatttgcatgttttctgttgatttatgtgcatgctggtgatccgcagttataacaagatccatgcattaattatgcaccatcctagcagacattcaggaaattgatttaaattaggaagttcctaaaaggttgtggggaaaattgaaaaggctgtcccaagtgtcatgttcttccattgcaggtgtttgctcagaaccggtttactcttgctttgcacataattctgtgacacttagctactgaactccaggtccacaacaaagtagcagaagaaaaaagatttcagaggctcctgattggctcaggatcgtggtggggccaagagcttggaaccaggtaggcagagaacatccaaaacgagatctcaggtgatactgagaagggcaggcaggcaaagcaatgtcagcatcagaatcacatgtggactgaggcgcacgactgaaacaccaggacaggggagttgaagccaggtaataagaaaggaattcaaaaggtagataaagttcagaatccaaggagaggaagaccaggtgtggtaaagcaaccagcctgcccagcaagtctcctcgctcaggccgaacacccagggccaagcagccttgtgtcagtcagggctctgccctcctctcgccagccctgtttccctcaaggaggcaggtagttgcatcttcctccactccccagttctctccatttgggtctgaggcaaagctaacacccatgagggaaatgattcatgcaataaattttaggccgggcatggtggctcacagctataatcccagcactttgggaggctgaggctggaggatcccttaagcccgggagtttgagacctgcctgggcaacacagtgagatcccatctctacaaaagacatattaaaaaaataggtgggtgtggtggctagtgcctggaatcccagctgctcaggaggctaaggcaggagaataccttgagcccaggagttcaagctcttagtggtctttggatgactaaacttcaacacatcttagctcaaaatctccgatcacaccactgcattccagcccgggcaacagaatgacaccctgtctctaaataaataaataaataaatgttaattgtgtagctattatgtgccaggcacaatgtggaaggaaggggatacattagtgaataaaacagatccttcctgcatggtacttagtttctaaatggagacacaccatcaacaagcaaccataaatacgttcttgcaaactgagagaagtgctatgaggaaaatgtacaggatgcaggggtggaggatgaggaggtcggctaccttagatgccgtggtcacagaatggctctctgtaggagattttgagctaagatatgttaaaagtttagtcatccaaagatcactaagattagtctatagtctgacaacttagtaactattgacttatggcagggcagaatgggtgaggggagggaggagtcgttgggttaggttcctcttgaagggctctaataagaccctgatagaccgaccaggttacagtccgatggtcataatccagatgagagatatcaatctttaactggggtcccgagcatatggggtagaaataacaagggttgttgatggattagatgtgggatttgaagtttaggtctaccaaatccctgggacccttgcagtcagctctttcttggggaatgggaagtgggttccagcaacctgaattcaagtgcatgacgaaaccagaaaaagcaaacgccaaaatcaaaactcggagcctcagaatacctgccaatagatgcatatgccccagctttccgtggagggcagtttaccagagcccagtgcaattcctaatttccataaagaacccacatacaaataaagtctgtctagttcactatggttaaggtagtcaggaagtgtgccacattttacaaaattttccacccaaaatgtttttttttaatggtgcttaaaggaaaaattctcatttacctggaaaacttaactccccaaagggaagtttcgttcagatagctaaagcatgccaatcccagtccccaagggaactgcaacaacgtctcaccgggcgcactgccttcagcagtcactttcgagtttgttgccaggtgtccgagcgggtttgaacgtccgcgtcaatccacacagtacaaaccggaggaggggccgggaccacgcttcccctccaggactgccttttgtacgtgtgttttgtttctgttgctaaggtttagggagctgcccggctaccctcacggattcccatggaaactaccacctcccagaggacaggaggagaggcgaattcagggtccacccacgggccccgcccagggatggggtcactgagggtccgggcagcgaagggcggggcccgggagctgggcatgggcgaggcaggcgcgagaggagaggggcgtggcaggtccggggcggggcctgagtgcgcctgcgcagtccgcgccactcagggagccggaggsgacgcgccggaggaaagatggaagactaccaggctgcggaggaggtaaccgccgggtcggcgacggaagggtggaggcctagagccctggccgcggaaggacacgcggtcctgcccggaaaggcctggctgcccacctccttcagctaggccagtctcggcagcccacggcctgagcttcccggtcgccggcgctccgcccggccccattctgcccggacattgccgccgtttccccggcgcggggggcgggaaggggattgagcttcttcccgcgcggggaggcaccgggcgtgactcggagagagcgccccggtgagcggtgccgagaaaccttcccgcagggcctcgcctccggcccgcagccaagctcgccgagaggatgacatcaccgccccttgctctgcggggctgaccccagccccagccccagcctggagcggggcgcggcggccgggctgggagcgccgaggcttggacgtctccccgcggaggtgcgggtgacgctcccgccgccagcccctccgccccgggctggcgtcccggccatcccgcgcctttgtctcgggcctcacctggttctgcaacgctgggaatgagtagcacatttcatttccgtttaatatgtctgtaagaaagctcattgttgtggggaaaaaatcatcttttatgcctccttgaggaagtaggataaagcccacgatgtcgccaagcagaagacacccatcggcaccgtgtgcgttaaatggctttccttcaagctcacggtcattcggggaatagagctgatgggcgcagctgagatacaacactcattttcttcttactgaataatccttgttgaaattcagatagagccctatggatttattatgcagcctgtcaaaaatataaactatagatacatttggtaaggttggatatcttaccatttatgaaatttagtggctgggcgcagtggctcacgcctgtaatcccagcactttgggaggcctaggcgggcggatcacctgaggtcaggagttcgagagcagcctgaccaacatggagaaaccccgtctcttttaaaaatacaaaattagccgggcgtggtggcgcatgcctgtaatcccagctattcgggaggccgaggcaggagaatcccttgaacctgggaggcagaggttgccgtgagccaagatcgcgccattgcactccagcctgggcaacaagagcgaaactccgtctcaaaaaccaaaaaaaaagaaaaaaatttcgtttaaggaggaatgttttcagggaaaataaaactaaaacttaaggactgattctagagtttcagttttgatctgatttcctaactagcacacacttcctgtgacagtggcataatcagtgtttgaatgctgatggcaaccaagtgaataatgacgagaagagctggttcaggagcagttggcaaagaaaaaagcctttccccttaaactgttactaatataatattggaaaatgtcttgtattacagtaatatcgagtaaaacttctaaaaaagaaatcgctttgtaaaggaaagcgcttaatactgcagtccgattctgactcccacaaataaggtggctaagtggcttcattattcgagatctcaatcgcatatgtgtaaaatgaaggggctggacagagtgatgagtgttctacctgggatggaggccctgggaggtggagaccatggctgtcttgtagtaggcatgtcttaggtatttactgaatggcccgttctggtcctcccaccagcctcttagcagccttttctgcatctcttctaacttcgtgtagatgcctgggcctttgtaactattctctcaactcaccattcatctttcttggagacgttaaaactatccactggattcaatacaactctgctttccactaaaaattctttaaaatgtccctcaacctttttcgtactgtaaccatatgggaggtgatacagtgcctttcctttgtgattaaggtcackgtagtcacttggaaggatcctttaagcttccagaaatgacttaatctctaagatattgcaaattgttcttcactcagtgagttggttttgtttccaagtccgacttctgagtacagcaagtgaggtggcttcgggcagtcagctcctgamcccccctaaaaagaaagggcagggcctgcagtggacagcagccagacagggaggaagactcactgccaagtcagggttctctgccttgattccctcaggatgcacgttgactgagggccccaggggttgccctctcgaaggcgtgtccagagctacgtacctttcctgggactcagcagtaactttaaacgcttgtgctcatgtgaagagcacattggcaggcaagtgcctgactaatgttattttcaggatgaccttttacccattcagatctaccatgtgtaaaaggmaaactatactcctggcactagattcctgcaggcagcccacctcctgagtcatccagacactgacagagaacagccatgctggcagctggtggttagtcctggagtcggagggcagcactgggaaagaaaaataattacctggagataatgtaatcatcgtacattttacaagtaatggtgctttaaaaaaatctcctcaaggtcaaactgatcctcctaatcagtttacatcatggaagagagaattacatcttaaatggattacttcagcagcttcagttaatttatacaaaaatcaaccaactcattaagcctctctattggttaaygattctagcagccagttgaaatggaagaagagaatgaattctagtttaaagtgaagtcttagattgtggcatgattaaaacaaaacagggccaggtgtggtggcttacgcctgtaatcccagcattttgggaggctgaggcgggaggatcacctgaggtcaggagttcgagaccagcctggccaacatgatgaaaccccatctctactaaaaatacgaaaattagccgggtgtggtggagggcacctgtaatcccagctacttgggaggctgaggcaggagaatcacttgaacctgggaggcagagattgcagtgagctgagattgcgccactgcattccagcctgggctacagagcgacactccgtctcaaaaataaataaataaaaataaaacaatacctttaaattatgtgcatgtattctagtcttctggtttctgaagactgtaatgccatccttggtaaagctgaacagtctagttagattatttctaaggtcttcatttctacattatgttcattacctacatttgcatttatcaatgtagtggaaatatcttttaaataaatcaaacttaactgaatgttcttccttacagactgcttttgttgttgatgaagtgagcaacattgtaaaagaggtaagaggagaaatgctcacttcttaaatgtttaatggcttatattagagaaaataatgtgttttaaatactatcttggaattgtttcgactgagtctgtgtgttttggtgtttcaaataacagtttttacttcagtaaatagctagataagagttgcttctatattatgtaaattacatattttaaatcagataaggagttttatgtacatagcattattactgcatatcaccaagatttgattctataatcttttaagcataaaagaatcctggtatacaaataaatgtctccagggttgaatgaagaaagagtgagtataagaaaattgaacaatcaatttccagttattctggacctagtgatccagtttggggcctatttgcttacttttcttacattcctaaatttcayactttattgtgttgttgatcatgaagaggaagagagacagaagggatgtttgttactcattcagaaagtacacactgagggagcgtgcagggcatagacccttctggartttacagctgaggggcaggcagggcagacacatcaaacagtcctgctggaaggtgtcagcctgcatttgctgtgtggtaagtgccactagtggtggtgctgtgagagcactgaactgggaatgtgacccacccagggagttcagggaccatttcgagctgaaatctgcagaatgagaagtaggggtaatgcagtaaaaagaggggacaaggccccctgagactgggaagtgggggcagtgcatggtgtgtgagggagtgaaaggaggtgggtgtggctggagcggtgctgagagctaggggctcattcctacctagggtaggaatgaagccagaaagagttttcctcatcagcttccctgccttccctgggtaaaatggggcacagatactaaagccattggctaaaagaaaactattagatgatctgaatttaatgatactgtttggggtttcagatgtaatttagaatttaatgtaaattattgactagtgtttgataaaaaaccgcaacctatgtttgtgatcagtatccaaaggcaaaatgattttgtttgaccatttacattgttcagcatcaggagtgactttctggttgctttgcaggatctgtacgtttggttttcatggtttttctaaatacacagtttcacgtggaacacagcagggggcaggaaggtgggtggattacaccagaactgggaacagtggagggggcttgttgggaagtctagttctgccgcagttgttttctgccttatctttgacttggttaccagctttcaattagcaagtgcaattgaaagtacacatttccatgctgggcgcgatggctcacacctgtcatcccagcacattgggaggccgaggtgggcggatcatgaggtcaagagatcgagaccatcctgtccaacatggtgaaaccccgtctctactaaaaatacaaaaataagccaggcttggtggcgcatgcctgtagtcccagctccttgggaggctgaggcaggagaatcgcttgaacccgggagatggagggtgcagtaagccaagatcacgccactgcaatccagtctgggcgacagagcaagactctgtcttaaaaaaacaaaacaaaacaaacacatttccaatccacatggaaacatgaggtgacattgcagtgttacttgaacttgtgtcactggcctcaacagcttttttgccgccgcaataggtaattctgtactcaagtgaccctaaatattgggtagtagtcaatttgcgcaggtccaaaattggtggagggttccctcctccttgaaaaactgaatttcaaagtatgtgcggagggagagctggcggagggagaggtttaccttcaacaaagcctcccccaccctttgacgggagaggtttagcttgaacaaagccccccctaccctttgacaatgcccaggtctagtaatactgctgttctcttaaaccgggacttctggccccccagccctcttgtagcctctgagctgggagggagcacagtggccgaggacaagaagtaagccagccctatgtgtaacgtgactactcaagagtctcagggagatgatcagcaggtcagtgggtagaaatcagagtgacctagggaggttttaggtcctcaaaagcaaggtcgccagatctaagccccaggcatcagatcccagtccatcaccaccatgcacagctcagatccctggactgctggtttgctctgcctgtctgaggacagaccttggccctcactgaatgttgttattttcactttaggtcataactgtcatagaaactcaggttcctggtttccagcacagcaagttaggggtagagaataaagttgctgagatgcaagcacactggcatccatgtgaaaggggagctgacartgaaaaactcagaaaatcatacaatggcaatatcataatgataagcttagcaagagcagcgacaatgagcttgcattgtcagataacccccaaagaatacagcatagataaagaagtaaacgtataataaagaaaaaaagttgggctgggtgctgtggcttatgcctgtaatcccagcactttaggaggctgaggcaggaggatcacttgagcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaacakgacaccctgcctcagaaaagtaaaaataaaaaaatctcatcataaacctaaaataagttttggaatataaagggcttttagttatctgaaaaatgcacttaatgtggtaacatgttctcagacaatgctggataaaagtattttttaatatatgattatttggatagctttgtatattgtcagttgtacaaatacaattcatctaatatatagtattagtgtatgttaggtagtagtagataaaagtaatatacttttaagaaatgaataggcaaaatactttctagcctcaacaggaaaaaaaatgtattaatagtagtgaacatgaaatgtgattattaggtcaaaatgtgtaaataatttgacagactatgaatttttgaagcaaatttcaaacttatttaaatgaaatataatgctattaaaagtatatttgcaaaggcaccctcatgattaaaaataaacttttcataaatcacttcttggggtgccgtcagttcctgattgaaaggtggtgtgggtgcatttggktaaccgggacgcgctttgtgctttgttttctaggctatagaaagcgcaattggtggtaacgcttatcarcacagcaaagtgaaccagtggaccacaaatgtagtagaacaaactttaagccaactcaccaagctgggaaaaccatttaaatacatcggtaatggagtcttgtttcttttatatttgcgggatkgttttttaacactgatcagaggggcatccagtaccagaaacaacagctaacgtggctcaactcaaggaaggctcctggtgggagtcggtcgtgtgtgtagtatacgtkagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccscagggagctgcactgtscgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacratgtagagkaaaaaaccaaatgaccgcactgtgatgtgaatggcaccgaagtcagatgagtatccctgtaggtcacctgcagcctgcgttgccacttgtcttaactctgaatatttcatttcaaasgtgctaaaatctgaaatctgctagtgtgaaacttgctctactctctgaaatgattcaaatacactaattttccatactttatacttttgttagaataaattattcaaatctaaagtctgttgtgttcttcatagtctgcatagtatcataaacgatttcttcatagtgagtggctacagaatctatacaaccagaccaggcgcagtggctcacacctgtaatcccaccactttgggaggctgaggcaggcggatcatgaggtcaggagatcaagaccatcctgtctaacacggtgaaaccccgtctctactaaaaataccaaaaattagccaggtgtggtggcgggcgcctgtagtcccagctactcgggaggctgaggcaggagagtggcatgaacccaggaggcagaggttgtagtgagccaagatcgtgagccaagttcccgccactgcactccagcctgggtgacaagagcaagagtccgcctcaaaaaaaaaaaaaaaaaaaaaaaaaaaatatatatatatatatatatacaaccaaaaaaaaaaaagttctgctgtggtcctctccatgatgtactcattttacccgtgggaccaggatcctgacggctctgctgggttctggttagattcctacccctcggcatcacacctcccattcttaagccctcctcttctagaggtgaaggggtgggaggtgggcaaaccaatttctattctcttagccagagagctctaactcacacttggcccaaagctgtaacaccttaactgttaatcctgtgttctctgtagggctcacaaattgtcttagtacttcagagcttacaaaatggttttcacaatcattcattctgtgtcttcaacaatttgcagtcatttaaaaatctcagaaaatgtgtttggaggttatctgattggtttaaagtcacacatccaagttgggagctgggcccaaacccacgccttgtctccatcttgagtgctcttccccaggccacattagacatggcaataaagatacctccgtgcctgcctgctgaaatggaaaagccctgccgttgtctccaaagccgctttattaaagcatttatgtctgcaaggccaaattaactccacacacaaagagcaaacaaatcaagacacatagaagtgaatattaaaaatttattaacatttcccagaaaggtagtgtcagaattaagccattcgcaaaagacgaatttgccataaacaaacattcacttttgcctgatgacagcaacactgtgatggggtggcactgtgccccacggacaggtccacaactgaacacatggctctatctctccttttgggcttaaagtttagtgttattttattttacaaatatttacagtcattttgtaaaaaggcagtttttagtagcagaaaattcttctgttttatagtatggtatcacagttactagcgtatctccaatgtcaaaccaagataaacagcatcacaagatgtcacagactaatacaacttccctttggccaggggaaaagatctgtatctttttttttttttcttcaaaagtctaacctctaaggcaaccggtttctaaaaccctcaaaatacacaaatacactttcatgttttaagtctcatcttcactaaatgttcagacacatccgttttaattatcccttttatgagggtctgtgtttttcctgtgataaaggattcaggaaataatttaccacattataatctatttaacataactaccctcagtaaatagttcataaaatacttgaggctggtgacatttgtcttgtaacctgctcatttagtgggttgggtttacaaaatgtatctaagcttttattgcaatctgcaattatgtacattaacaaccttacaaaccttgaacatagtatatatatccccttctctagcctttcaaatggggcttaagagagagaaaatggcaccacttcactgctataatgatttaataataaatcaagcagacttatcatccacatggataacgaagctctccctagggaaactgaaatacctctggtcatcttccaggttctcctagactggaccagtatttaaaaaatcccaaagatgatgttactcaagccattaccatgaaggaactaaagtcagccctttaagttcgcaaaactttaacataactaccctcagtaaataatttattttttcttcaacaattttcttgctactgtcaaaagtttctggcagactttagtgttttaacctgatacctatggtacatattctacatgccaagtgctagagagtttaagcaaaattttacatggggtatgtaatatgtcggtatttatgatataccagggaagacaagttgaaaatacatgacttagtaagaacgattttccccttaagtactttctttttttcttatttcccacttagttacaaaaagtaaataaataatcctatatttttcatttcattgatgcatgaagactcaatgtatgaagataatagtcatcagtttataattacactataggacaaagttttaaaaagttctagtgtgtgtatggctaaatgcctcaaatattttacatttactgataaataacagcattccaaaatcatggacaattatgattaaaagttgtaaaccatatcacagaatatgttaatcagcacatcttcatcagtttacataaagttatagtagtcttattagaagttgtaaaatttggtaacagaaaatttttttcaatacacagaataaaaaaaacatcattgcaaatttaaaaatcatgtaaacttgaattacccttgcagtaagttgtcttaaacattcatatttacaaggtttttaaaacaaatgtgaatagaatccatattaaaagtacattatcattaaagtttaaattaaaaggaaagatacaaaggaaagtcataacaaatagtttctcatgaacatctctaaggtcctacctagcactacttaacgtggatgataacgtgaagctctgcatggtaatctgagagtcaatgcatagatgaagaaaaaaagtaggtactgcttgcgttgcggaactatcatcttctggacctcaattgccaagacggcatcagtcaggttgcccacagttaccagatgttaacagaagtgtgactgtagaggtcaagaggaaagcacgggagacgtccacatgagactctatatggagtccctgactgaaaggaacggggaagctccagggccttctatgatgccacagattcagcagtgccaaggactttacagaacaggtcgtccctacctgaccgccatgtggacacatggaggacagggaaccccttccggaagcacgagttgccttctacccaaatacgttttccatgaaccatttaaaacattttacttgcttttcattttgcttccaaatatgagttttaaaaacttttggccaataaataatctaaaatattctatcaatctttcatgtagctttatttatttatgacacgggttctcgctctgacacccaggctggagtgcagtggtgcaatcatggctcactgcagccttgacctccagggctcaagcaatcctcccacctcagcctcctgagtagctgggactatgggcatgccccagcatgcccagccaactttctaaatgttttatagagacggggtctccctgtgttgcccaggctggtctcaaactcctgggctcaagtgatcctcccaccttggcctcccaaagtgttgagattacagatgtgagccactgcacctggcccctcatttagcttttacttacataaataaataaagctctatggcatttcatattcaacagaattgcagaaactgctatttactggaatggtaagggttcctctcctgcccatacctcccacaggcaaatccatttaatcatgtgtgtacacacaggcccctgaaaagcaccatggcagtaagaccttccccacatgagttggtaacctgtaaattatcttagcctttccttattcaacttatcaaaccctcctcagaactccacactattacttcccctttggtgacgtgaagggttggaaccccagcatctcccattcccgatgagtcataactcacacactgcacaaaacgcagtccacataactgaccaatcacttcagccacctggttacccagggcactggccactcaacgaggaaggactgccctgaagcagccacagataaggcttccctttgagtttaaagggtcacaaaacagtaccatggaaaagggaagaaagagggtgatgctgtcacgctgaggacctagtcacaggctgcccgtgaacttggaatcagtgaatgattacaggaaaaaaaagtacataattcactgtactaaaaacgtgaaatttcctcatcactgaaaacacgctcatctgaaatctctgtaaaaaaggatttggctgttgaaacttgttatcaatgcctcttctcgtagccaccatgacaataaatttggctaaacatttaaatttaccctcagttttggttttcctttaaaaaaatatgtaaacaaatgaacaggaaatctctgcttgtaagaaaaatctgaatataacaggggaaggtcagcagacggtcaccggggaaagcatccaggcatcttgtcgcctcgctgggctggccggggctcagtcactatctgactcctccttgtacttggcccggatggcctggccgttctgcagcggcatttcctcatagtcactcctgtgagcaaagagacctttgagaccgtctaacttctgacagctctttattttcctcttccacactgacacaccattccagcaggaattaaatcatagcttcgctctttcaattttctatcaccaactgctactgctcaccccgtcctcctctccctgacccccagttcccagggcccatcagtccagaaagcacagttcttcccgtggccagcacgccctacaggtagccagcagaaaggactactaccacatctaagcctgaatactgtgaaaacagaaaaccacgagccacttgacactccaaggtaaatgccttcataccttgaaaataattttagaagagtaacccattcagaaacatgcaaggccgtgccgggatgcccaaggtgtgccggccttctaacggacagggacttacccataaatcacatcatcatccgagtcattcagcatggagaaggcaggattgtctttcagctgggactctgaaaaccaacaagagcatttgcatctcaagcaattgacgtgatgagcctggacaggcaggatgctgtcccggacaaaggaagggagttggaaagaactggactcaaatcgcagagctgccatgtctgtataaacctgaacacatctcgtgaggctgttttctcatctacaagacagggctggcctggcctgcctggcagggacgtcctgaaggctgagggaggcggcctgtgggaaggagcaggcaggctgccattgcccacgcacgagctgcctcctgttgacacaaggagtggggagctgaacataggccccaggagaggtggctctgccctgcctgcccccgcccagtccttggacgtgcagcgagctgctgcttctgtaaaacgggcatgattatatgtttatcataaagttgctgtgaagcttaagtgagacgccgtttgtgaaggtgctgggcaagtgctagcccactataagatgtcggggggtgcggggggctgcctatgttctagagagttcccatccttttcattccctgtgcaagagggttgttttggtttcactattaggtgactttttgtatgttttggctttttttttttttaatggtaacaacactactacagatgctccttgacttacgatggggttatgtcctgataaacccatcgtcaggttgaaaatatcgtgaagtcaaaaacgcatcaactacagctaaggcaccgaacattgcagcttagcctattctgccttaagtgttactacattagcctatagttgggcaaaatcatctaatgcaaagcctattttatttaatttttttttaagagacagggtctcattctgtcac

SEQ ID NO: 12447 - DNA, 20389 bp, Homo sapiens
tcactcatgatcatacccctttcctggtcaagtggggagataaggtccagcccacttaccctactggggcatcctgcagagccatcctagtttgagctcctgattgactgaggcgtttgttaagactgcatcagctcaatttctccctctacccaattctactgcctttactccccaataggtgttgatgcagataactcctcccaataaacttcctgcatgtgaatctccaacacagagtgtttttgccaagaactcaacctatggcaggtatttaaatgctttttaaggttagctgtgtgaaatgtgtgctcgttgctcaatttcagagagtttcgtgatggtcatgttgagagatgctgtgtgtgtttaattagcctaccatttcaaggacaataggaatggggatcattgaaatggcaaatttcagtgggcttggggctcatgccgaggctgcaggtcctccccaaacctcaggagcgtgtccaggatggcagaactctgtgcttcagtttgggggttaattctgggtgtccccaactcactagggattaactggggtacagaagtgtatgcatctacttcaatctagattagcgcttcctaaatactggggtctctgcaagttaatggaggctcaaacctttcaggaagttctgttaaatccaagactgagtgtacctaccaaaagcagtcaaccatctttcaaaacaagagggtcctgctgggagatactggcaatgagaagttcctataggaccataagatcagtctggggctgggtgcagtggctcatgcctgtaatcctagcactttggaaggccgaggcgggtggatcacctgaggtcaggagttcaacaccagcctggccaacatggtgagaccccgtctctactaaaaatacacaaaaaattagccgggcgtggtggtgggctcctgtaatcccagctatttgggaggctgaggcaggagaatcgcttgaacccgggaggtagagattacagtgagccaagatcgtgccattgcactccagcctgggcaacaagagcgaaactccatctcaaaaaaaaaaaaaaaaaaaaaaaaatcagtttgggcttcaatatgcccaaataggctatgagggcacctatatttacactgattgccctttattggtaacatctccatctgagggtggatcctgtctggcatggtgaccaagataaaagatgcaaaagatcaacatcatccaccaagactatttccactacatgtgtaagtacagttgcttcaagaagcacaagaacatgttcatgcacccatccccttgcatcagggatgtccagatcagcaacatcatcatggttgggtaagcaccagcatgagcaagatggtacacttcaacatgctcatggtccccaatgccaccaagaagcaattccagttctgagtctggatgcctgcctactccctaatgtgaaataatgttattttcccattcaaaaaaaaaaaaaaaaaagaaaagaaaagggtggggaggggagaaatgctaaatttcagatagtgccagtgccacacttgagttacagagctctgtcaagtatgaagttggctatagttatcagtgcaactactgatgacagactttctcattagctgagatgggatgaaagtgtttaactgactcagagtggtaggtgagctcaaataggaaagaaaccaatgtctggtatggatagcaaaggagtcaatgatcccatctttactaccctaaactgcatgacctcacattgtatttgagtgaccttggcacaatccacctgaaaatgaatgtttttttctactaatgaaactctgaacttacagaaaactatctactttcaggccaggcatggtggctcatgcctgcctgtaatcccagcactttgggaggccgaggagggtggatcatgaggtcaggagtttgagaccatcctggtcaatatggtgaaaccccatctctactaaaaatataaaaaattagccgggtgctgtggcacatgcctgtagtcccagctactcgggaggctgaggcaggagaatcacttgaaccagggaggcggaggtgcagtgagctgagattatgccactgcactccagcctgggtgacagagcaagactctgtctcaaaaaaaaaaaaaaaaaagaaaaagaaaaaggaaaaaactatctactttcgtttatctcccatcaagacatccattcatccattccagagttaccttttgactagctccctatcttaatcttggtctagaaaattaaggtaacttctttttcagaatttcaggagctggttcaaggaaaaaagttccctttttaagcttctttcatcccagctttccaacaattacccttaggccttactcaggtcttagagaagcagaatccattgtgcttattcacattgatgactacatcaatgtatctaagaagagtaagtgttaagaccaaacacatcatcaacttgttcagcacaatttgttcataccacagtaactgtgggatgcagtctaagatattctcttctttcctttttagcagcaaacctctgtgactcaaggaaatctcagttggatgtcctgtctcatctactcaagaccagtaagcaacacttacttaaaaagaacatattctctttatttctgcttgggatacaaatgttcagtttggatgatgagaatgaggcaagtactggagacaatggctggctctcctgtttgtcccaataaactccaatggaggaagaagctaaacaggttttggatggtttcggtctactgcatctagcttatcaaatctacagcctggtacttctggaacaggacttccctgccccagtgatgacagttaaagatggcaaaaatgaagaattcaacatgtatacgcagtgcagtctgatgtcttcagatgttctctaaaattctgtatttggtcagagctgggagtgagatcagggtgcttgcacatttctgctccactgctcccgattctgctttgctgccttggagggagagtagatttagatctgggggctggtgggggccatagccttggcagcttgctgggctaaccagtacttatatcttttggtcttgggcttctcaaagttcacgacagacataggcactctcacagtatcaagcccatttacctgcacacaaaacaatgggaattctcagagatcagtcaggtaagtaagatttagcaccacctaatcccagcttttcaccctgacttttctcccagtcagaaaaaggagagctagggctgggcacagtggcttatgcctgtaatcccagcactttgggaggctgaggcaggtggatcacctgaggtcaggagtttgagaccagcctggccaacatggggaaaccctgtctctactaaaatacaaaaattagccaggcacggtggcgtgtgcctgtaatcccagctactagggggactgaggcagaaggatcgcttgaacctgggaggtggaggttgcagtgagctgagatcgtgccactgcactccagtctgggcaacagagtgagactccagctcaaaaaaaaaaaaaaaaaaaaaaaaattagaaaaaagggagaggtaggtgctaggtgcggtggctaacgcctgtagtcctagctacttgggaggctgaggtgggaggatcgcttgaacccaggagtttgaatccagcctgggcaatgaaacaaaaccctgtctttaagagaaaggaaaaaaaggaaaaagtgggggaaaaggagaaagaaaagaaaaaagaaagtatgcaaaacactcaccgtcacctcacaccaatactcgccccaccgtgtgataggctcttctggtaactttaatgtatgtggggcaaccacaacaccaagctgcaaaaaaaaaaaaaaaaaaaaaaatctcagctcaaatgaactctgttttcatgactgccactctagggaacctcataaagagggttacaggattccctgcacagggatgaataaaactggggtgtctactctggctgattccatgggagagaagggcatacaccttcatagacggtagtagagaaattcaattctgatttctcagaaagggaggtagattcacaaagagaaacagggcttgaggccaaaaccacttcatccacaaaagtaacaattctccagtgagtcacaaatccccagcatttccctaggtagacaggaaataaatggaaaccaccaccttttcctatcagtcttcaaattctatgtgaccatccttagtccttagccatttccttcccatattcctgcaaactaaccaagaatactttccttaactacaactggatgatcacaccccttcctaacaaagggatcaatcccaggcctcctttccagaggcagcttccacctcaggggtagagtggtttttgggaacactcactcacattcttaaagaagtggcgggcaactatttcagggttcagctcccatttgacattgttcttcatccctacctccaggcgacagctttttagaaatttcactgtctgaaaggaattatgagtttgagtcaaaggagaggaaacatgtcagggtcacagggtatgcaagccaagcaagatggctcatgcctgtaatcccagcactttgggaggccaaggtgggtctcccaaagtgggtcacttcagcccaggagtttgaaaccagcctggccaacatggcgaaaccctgtctctaccaaaaatacaacagttagccgggcatggtggcgggtgcctgtactgattatcttctcatgtgtccatgttctctccaacttgtacgtaaatatccttgaaggcagagccctcatctcagactattccatgggttccctgattcccagattgggacctcccttggtactttaaggcacttcacccaacacatcagggatctcccaagaggtctccatacctgttttgtggggcagccacaacacttcccctttctcccactcttgggtctgcaatcaggagacctcaagggaatcagggagactctcagggtgaggttggtaagtcttgtgacaaataaacactttttatgtttctactcaccgcctcacctgccttggtctggatcttctctaattttccttcttgtctcagctagaaaagaaagttaaagatgaaaagcagtaaaagaaaaatgagcccatgttaaatagcatcaaactattcctatgttggacattggctgggcttctgcattcctgttcttctagttcctatttcattttcaagttaagttaaatgtcaaagggaaggaagctgcaagagaaaagaagttttatctccccaagtctctctgtccttcctttgagctcaccaatttctcctcttcaaacagcttcttgttttcaggggatgcatatacagccagtccctgaggaaggagtcgattccggcctaaagatttcttcactgagaccaggtcaccccggactccaacatctgtcaattagaacagagacaggggaattagaaccatctaggagtccctaaagaaaagatgtcaaaaagagaagcacctcttagtttctcacagtgcttatttttcctaaaagaaatgctaattcatattcactaggaacaagatttaagagactgctaattagtttctttagaacttgatgtataaatttaatatcccctgtatagagggagttgtcgtcccatggaggatttcagtatctgtggcacaaattgtcaggctcctctccccacacactgttaatgatgttgctgcctttatgttttaattttcaatgctggaggccagtgtcacaatcacaatagtttttatggcttcctcttctcacatatagagttggattgtttccacaaagaaaaagcaaggcaaatagttgagggggacgggctagaaaaagctgatgccaaaccggaccagcctgagaggaagcgcctcggcccgggccttactctccaccgactgcgtcaggatgagctccaggttttctttgggccgatgcttcgtgtcctccaccagcttatagacgcgrtgtcgccggtgcaggcgcggcttccggcccyccccggccagcggtaccttccaccagcgctccacgatgaccgtgccctggcggccaggaaagcgacggtaagctagtctccacaaggaacaccctctccctccaccacggccgccagcccctcaaggaaagcccgccacccccacatcggccccctccaggtcccagtgcgcctccagaaacaatactcgagcgtatctaccccctaccccagactcagccctcacccgattttgagaaaggctgaagttgcaggccaggtcaggggcgttcccttcatgtcgcggccgcagtagctcctggacgcctccccgaagcagccgtccagcgcccgcccgcagcagagctctgcccggggccgtgacaacgggcgccgccatgttcacaggcacagaatgagacctgagggaggaccccggcgtcggcggcaggaaaggcccccgccagtgctgcctgcggcgcgccggtacggctgagcgaaagtatggggagcgggccggggaacagatggcaccgcggcttgcctatttttgctttttggcagaggtgacggacgcctagaatyactgactgataatggaatgagtgttaggtggactgacgccggaaaagacgctcttcctcttgaaagtgtgggctttgctgtagctccagttgctgggctaacttttaattctaacgttctgtgatgactggatactgaccggagaatgaatgatgctctcacttttccttacttcaaatctacctaaaagtggtaaaggatgggatcccttggaaaactctgccagctccaggaggagcctgacccttaatcattatactgcagtatttaagctaataaaggagaattctaaatcacaagctatgtaaaccgtagraaaaaaagcaactatggtaaggccgcgacagttccctctggggagggtctcagtactggacagaagaccataaaaactggatgaaagaaggtccatttggcagagattatggaaagactggcccttaaacatactgaccagtcctccttcctcctaaatacactacttggcctcctggacaccggtcttcttcagtctcgtttgctgatttctccttttctccccgcttcttagaatgccctcgggactccgtttttgaacctttactcttctcagtatacactcactgttgatctcatccagtctcgtggcttacaataccatttataagccaatgactcccaaatttctagttccatcctagacatctcccaaactcgtctcaaatattcaactgtttattcgtcattttcctcttaygtatccaaaggacacctcaaagttaactgtcccaaactaatttatttattcccccctcgcccccaaaactgccccatctgcagcctttttcctctcagttgacagaaactccattctttccattctaactcttttctctcatactccatcaggaaatcctgtgggttctacctttaaattacagatagtccctgacttggatttacaatttttgagtttgtgatggtgtgaaagtgatgtgcactcagtaggacatcaataagttacatgaaatattcaacactttattataaaataggctttgtgttagatgattttacccaactgtcggataagttgtctgagcatgtttaagataggctaggctaagctatggtgtttggtaggtgtattatatgcattttcaacttatgatactttcaacatacgatgggtttatcaggacataaccctattttaagtcaaggagcacwtgtatttccagaatccagccacttgtcaccacctccaatgctctaccttggaataagacactactttctcctggattactgcaatagtcccctaaaagatatcccttaattctctacagtttataattctatgtagcttatttatagcagccagaatgatctttttaaagcataagtcagatcatgtcattcttccacccaaaactttgtaatgacttcctcctttactcaaggtaaaagaaaaaggccatcagatggtctacaaggccatacatactctgaccccattagctcctctctaatttacactgctccacccacagtggcctccttgtttcttgaaaacaccaggcacgtttcctgctcagggcttttgcactggctgcttttgcgttggatgctcttatcctcagatgctggcttggttaacaacctcacatcctccaagtgtttaattaaatgtcagtttttttcagtgagagatcaccctatttcttactgtaaccctgacccatccccttcacattccttatcttcctttatcttgctctattccccccaccccatagcagttaccttctaacatactaaacaatttactatgtttattttctaggtttgtcctctcacttttagaagatacgttccatagggcagggatttgttttgttcactgatgtatcatctcaagcacctagaatagtgcctggctaatagtagaccctcaataaatatttgttgaatggataaatatgcagaggtctcaaagtggcagtcccagaaccaaattttgcttacaatgttgtttttttatcaacaattttttagtagttgattttttttttttttgagttggagtctcgctatgttgcccaggctggagtgcagtggcacgatctcagctcactgcaagctccgcctcctgggttcacgccattctcctgcctcagcctcccgtgtagctgggaatacaggcgcctgccaccacgcccggctaattttttgtatttttagtacagacagagtttcatcgtgttagccaggatggtctcgatctcctgacctcgtgatccgcccgcctcggcctcccaaagcgctgggattacagacgtgagccaccgtgcccggcccagtagtcgatattttttaaaattggtgagatttactacaaaactgtctttccagtttctgttcaaaaatcatacgatacagcaccatcaagtctgcattcttgcatggaactggatggaattgagttgtgtggacttcctttagataacgtgtgagctttcctattttgctacagccctaccctgccactccactaatttccataagctgtctaggcccctgaaggggcctagacaattagtttgcaattcctaccctacaaggatcctgggttattaagggtagggatgataataaaaatactcaactggtatgaactgggaaccaactaatcaggtcaccactggatcagagccttggaagagtcagataccaactctttacttgctggattttgggggaaggggagtgtccacagaggagcagggtgggtgggcacaagtgctcaggcagggcttttggccaaccagtacagaagtcttcaagttctattttttaatcattcatacagccataacatgcatactagtcgaatatgagccttggataagggattagggtagataagcagcagagtggagtcctgaggtgacataagggctgaccccttatccatgtcatagtgcccactgggtcacaatgccaccaggttgcctaaacctctgccacccacctgtgaacttcactttgccacagggaggcactgaactgaaaaactgccttgtaagaggtgtcgcccctctgtctactccctttcttatatcaagaggggaaaaacacgtaactacctctacccgatctggtcaccatacgcctattacctttactgttacaagtaccggatcactctccgggagaagatgctgcctcgttgttataaaaggtacttgttttcatctctatttgtagttgtttatataaaatgtaaggaaaaagtaaaagaatttgaaagaatttcccaaatggcaagaaataacaacagaatagggggtggaaagctggcatggaactttagaatttttccatctggttgggcccaggaacayagaaacaggctggacaacagaaaatacagaagatcatgccagagcctggtactgtgtatcttcccacctcagattccaagataaactaatttgggtctctttcccaaccagcatcacttataaggaagaggaggacttgacactccagccccgttcctgcctccagtgctcctgagtccctagtaggcctccaggagggcaaaagcaccgagcagggtaaccacgaccagcttaaagaactgtattcggtaagtggactgtgagctagtgctgtgacagggcaacccttttcttgcataccttgcagaggagggacattagcaagttggaagatgaattacagaggtagatggaatcttggaacgcatgtgtaaaagctacttgctatatagacaagcattctggcccacagactgtaaaatcaaggtcatacagatggtagtgaaaatcaggattgggaaaagagggagtggggacaaaggtaaaacaaactctgtaggacttctgggacataaagctgtttatgccaagatcctgcttaaagatgctaagcaggatctggaatccagaacttgcccacatatcatattgcaataacaagcctggttgtaaccatggcattttaaatagaagaatttagagaaaacccatataatgaaaaaagtggaaattattagtgagaaaggaagcacattataaagctttgtttaaatcctaagctctctgatgtaaacatttctaagttcctaaatggttattgtactcctgggttgaagtcaacaggcagtaatactgcctcagctggattgtttgatataaaggagaactccacaataggcataggctattagttcctgggactaagggatattattgcatctttaagatcttgrctccaattctcccaggctctccccatcaatgcccaccttgcttcaacggacacaccccmatctgcctgaggtctgatttgaagactagaggagcatttttactccttttccaggctgggaacttgacggtgctggctactgaccccctgctccaccaggacccagtacagttagactttcacttccgccttacctcccagacctctgcccattggcacggccttctctgtgaccgtcgactcttcytggatatcccatatcaggccttggatcaaggcaaccgggaaaggtgactgagcctggatgggagaatggggagggaataggtaggggatttcacccttctatcatgtcatagtacataaggctaattctggagctagatataagcaatccattcacctggcatgcagacaagcctgtgagctgagccaggatctggggttcaagggataagagtccatgggaagctggactcagatccagaaatagttgaataacgggaagtactttctagctgttcatctcagtagtcctttctccccagaccccttctgtggcttacatccagtgatgtgcaatctcttggcttccaagaaaaatctaccaaaactagtttagcaactttcatttcctggcttgggtgggtggagggcagaaaacgaccaataatatttttactgctccaagtaggtgtctttctggattctgagttggccaaatttttttttcccagtatttattgatcattcttgggtgtttctcacagagggggatttggcagggtcataggacaatagtggagggaaggtcagcagataaacaagtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacgtttcagagagcatggggttgggggtaaggttatagattaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcgtcatcatggcccattctcaatgagctcttgggtacacctcccagacggtgtggcggccgggcagaggggctcacttcccaaaaggggcggccgggcagacgcaccccccacctcccggagggggcggtggccgggtggggactgccccccacctccctcccggacggggcggctgaccgggcgggggctgccccccacctccctcctggacggggcggctgaccgggcgggggctgccccccacctccctcccagacggggcggctgaccgggcgggggctgccccccacctcccggacggggcagctgccgggcggagacgcccctcacttcccagacgaggcggctgccgggcggaggggctcctcacttctcagacagggcggacgggcagagatgctcctcacctcccagatggggtcgcggctgggcagagacactcctcagttcccagacagggtcgtggccgggyagaggcgctccccacatcccagacgatgggcggctgggcggagacgctcctcacttcctagacgggatgacggccgggcagaggcgctcctcacatcccagacratgggcggccaggcagagacgctcctcacttcccagacggggtggtggccgggcagaggctgcaatctcggcactttgggaggccaaggcaggcggctgggaggtggaggttgtagcgagccgagatcacgccactgcactccagcctgggcaacactgagcactgagtgaacgaggctccgtctgcaatcccggcacctcaggaggccgaggctggcagatcactcrrggttaggagctggagaccagcccggccaacacagcgaaaccccgtctccaccaaaatacgaaaaccagtcaggcrtggcggcacgcgcctgcaatcccaggcactcagcaggctgaggcaggagaatcaggcagggaggttgcagtgagccgagatggcrgcagtacagtccagcttcggctttcacaactttggtggcatcagagggagaccgtggagggagagggagagggagagggagagggagcggccaaacattttaactgtttttctgtggctcctagtttgactgcaaccctggagtacgtggaagagaagacaaatgtggactctgtgtttgtgaacttccagaatgatcggaacgacagaggtggggatctgctgttcttccttgcttttcgcgctgaggcagctggataactccttttcctttayaggagaccctcttcccctgtctttaaaaatgcaccctcaggcatttcagggattcttttcttcccacctaccacgaaggtgggaagttgtaacttgttccatcaagttacaactggactctgaggaagcccctgcaggtggtgttaggggccagactgaagragcactggtgaaattacacagaatccattcaagggatgtggccagcaggacaaaatggatctcaaacatatggagcacctacaatgtgaaagggtcagacataaggccaagggaacggggacatatttaaccggatgcctggagcatatgttacagaaactatagcctcttgcctcaaggagytcaaactctgttggatataagggatggtgaataaccattcataagtgatagatactatttcagagcttactatgycatcattgtattagtatataggtagacctcactaatctctagtgttaagcacttcakgaacatctcatttcatcttaaattctgtgaggaggaaggttctatgatttataaatggaaaattctatagatggaaactgaagttctgmaggactaactcacagaacaagtgttaaaaccagagttagagcctaggtctgttggactaaagcacatcctatatgcctgcactacactgcttcccagggccactccctagtggaagaaatcaaatctgggggcatacatgtattgagttttaaagcatgttctaatcatttgttctatcctttcacaggtgccctgctgcgggccttcagctacatgggctttgaggtggtcagaccagatcaccctgccctccctcccttggacaatgtcatctttatggtgtatccccttgaaagggatgttggccacctgcccagtgagcctccttgaacatgcttattccaacgctttgaggggctggaagccttgacacatggaatcaggggcccgggatgtgattcaggacactttccatcctaggaataaagggtagtgcaatcatcaagtgttcacggtttcttgggggggtgggtaatagggttgactggagtgggatatacaccttaacagagctaaattcactgaaaagatcacagggacctgaactacggaggaaagtacctaaggatttttggttccctttgccttcctccatgccccaaactatttccccatttattctaaccatttactgagcactaatcagtgaacttcctagttcagaaagactgagctttgttaggctgtttttatccatatatttcagttgaggtgctatagatgtggagaaaaccagagaaggcacatagatctcttggctttggcccaagttgggggatctcaacggacagaataggtaacatagaagagggcattccaggcagcaggaaaagtactgggttatactaacagaatgacaaagaacccatcagaatgggctgtaaacaggtaagacttaaaggcatattaaagaaaaagacttttatacatagtaacaaactgcaggtaagaatgagacattactcattttccagggtaggaagtcttatgaatgatttatatcagggaacctctaaagagtaaaggttccctacggaactctggtagcaccagttccagggctgagcatgcttcagcgagttcattgcaggcaacatctgaaacatcaaataaatggaagctccttaaagattcctccaagagtacctgaactactcaccagaactgttccttcactagagcctttctgctaattgggactgagatttttcttttctttttttggagacagcatcttgctgtgtcacacaggctggagtggagtggtgcaatcttggctcactcactgcaccctctgcttccctgggctcaagcgatcctcccacctcagcctctcaagtagctaggaccacaggcacacaccaccatgcctggctaatttttttgtatttttggtagagatggggtttcagcatggtgccaggctggtctcgaactcctgagctcaagcaatctgcccgcctcggcctcccaaagtgttgggattataggtgtgagccaccggtgcctggctaatactgagatttttctgagaaaataaattttgagaattgtggttgtgagaaaatatagttgccatgtagtatagaggtagacgttactaatccctaaatttaaaaaaaagacctgtgtaaggcatccttatgtgctagttttaaattttctagtttatcttgctttatccttaaaaaaaattcacttgccatttttctaccatccacattactatacatttatatttactttcaagcacctcaagtacttcaagcctcgcatttgagcctcacagtactgtcagaaagatgctataaggaaacacgttaaaattttgcaaaaagtttacagtggagatctactccttaaagattcctccaagactacatgagctacttaccagagctgctcctagaatccaggtttctagaatcttaatctgggccttttcttttgaatagtataggtggggtcttactcacacagcctaaacctaaattggttctggttcctagtgaatttttttttatgagacaaggttgtgtggtggtgcaatctgggttcactgcaacctccgcttcccaggttcaagtgattcttgtgcctcagcctcccaaatagctgggattacaggtgcctgccaccacgcccagctaatttttgtattttgtatttttgtatttttttgagacagagtctctctctgtcacccaggctggagtgcagtggcatgatctcagctcactgcaacctccacctcccaggttcaagcaattctcctgcctcagcctcccacgcagctgggacaacaggtgcatgccaccatgcctggctaattttttgtatttttagtagagacagggtttcaccatgttggcctcaagtaatctgcctgccttagcctcccaaagcgctgggattacaggtgtgagctaccgtgcccagccagtgaatggttatttctgaagtgactttagagaaagaatatgaatgtgtatatgggagggacacttgtttcatagatgtgatcctttctgtgaggcagttggcagttttcaccagatttaggctcacagcctgcttccaccttgtgattcaatcagaatttggttttagaaaattttcttgagaactttattcagcaaaaaaatcctccaaatgattcaaacaggactgtatactcttcctctctctccacgggtgtatatgtgtgtatacatatagatattatactagcaatttagaaaatttcctgagcctcctgtctcctttctacttatattttaactaaaggttacagagaaatagctggagcagtttcaaaagcctgtctccaataacatatcagcaattgaggctgggaggcagtattctcttcccacttcctgaggcttttaaatataattatgctaatttttgcctttgcctcctgattcaactggagtctttgagttcaccactcaaaagctttccttaaccagagtcacctgataaggtgagtcagaagtctgcagaatcacttccaatgacgaaagcctgactgtttcccagcctcaaaaaggatacagcctagtagtaatgtgaatcatgactggtagaggggactgagcctgacgttgaacggcctggaagtaacacagcagtattcaaacactggagggttggggagggatccggaggtggaatgggggagacacacttgtagcgtggtagtccaatttttttgtagtctgatgggaggagaatattaatttggtccacagcaagccagactatatgtgtaataaaggaaggactgcatggatcctttatcatacactcctctcctccatgcaccaattcctatgccaaatcctgccaaagacagaaatacacaaaaagcttgaaagtgctcaatctgagagcaagttaagctgcaggaaagcagctgcagagaagtatattaagacagggcatgggaaagagggaatcaaagcaagtgccccactgtcgccctcattactttcctgttgctacagatagatgatagctgcactcacacagcaaagcagatggctgagcaaactgaagcccagacttcagagtaagtagtcatcttcaaggttatcatcaccagacatggaagcagcttctattgaagataaataagaaggagaaagttagacactgccctattctagcaggcaatgccagcgaggctcaaaagaaaaatggacctcttggtactcaatgacctgactaggaaccaagccttcaattaacctccctactctggaaagactgaatgagaaaagttaatctccaaagatgctctagggaggaaatactgcttgtacctgataagctgaggcaggacagggtatgtgttatctctccagagctctttttggtctcagtgagcaacgtgctgagagaggcatctgtttctgtggcctgagtggatgaaaacaggaaaaaaggaggaacatgttggcttttaggaaaaaagaggccaccctttcattcttctcataggacctggttaaggcagttgcatttggctaccaagagggacaaaatgctcctttggtcaactactggaggagctcaaagtccttaggaaagctaacacagtatcaggactagaagcccttagtgtctatgtgctagatttgcctggaagcagcaccctatataactacaatagctcaccatgtccttcaacatgtctgggacagctctgttttcttctatgtcttcaggaagctcaattgcgtatcctttgtgtactaattctagcccaatatcaagtttctgagaagaaaaatgaaaagggaatgatgttctctcagtaagcaagggcaaatttgaggaaacaaggcagaaggactgatactttaaagacattcctttggtgagatggtgagaaggatcttacagtaagagtaatatcagataagggtttctgaggaagaaaaagtaaattaggctataaatatactgaagatatggcaagcagtgagtgaatgccagtcttaccttcccattgctagtatcatataagtagatctttggccaagttgagatcccagtctggacatagctagagatcttggctaccagaggcttccagtcagcacaatgagtgagtctatcaaactcatccaaagcttcctcttcccactggtcacctggcaaaagattgtaggggttactgctgataggggtggggcttataccctggagggaagttggaactacccttttctactcaggaaggcacctgtgtcttctctggttgggttgggtctgccaggcaagtttctggctgctgctagtgctggtgaggaaaaggcacctgagtccccagaattcaaaaagcctgggaatgtgagaattccttccaatgaactgtatgaagttattctatttggaggtaagctcaatagatggcatgaccaatttacctgagggagcaatccgtgccagactacattctattgcttgaaatggaaggcttaggaagtcactcctgaagtaaaagaaactaaaattagaatcctggggccaaaaacatcttcttacattgctgctttaagaaagaaccaactaacatgagacgataaccatctgctctctgtaaacaggttcccttccaaatccccctgacaactgccaacagctcaccaccctatggccagaactgagtcagcagttgggattgagctgacctcagcactgacctgagagccctgaggtccttcagtgggcaatctccattatctccaaagtcaacaaaatagaggtccaagttcccattctccaaggtgccgaggacccgggctcgataccaggaaccatttgtaggtaaaggtgctgctacaatgtctcctacatgcacagtcaagtcttcaggctgtatgtggggaggaggagaaaggcagagagttacaaagtggtaggctcataaacagaattgcaggaggaagaaagaaaagtagttgctccacagggaaaggaagagtacaatgaaaaagatatgccttcttttcattaaaccccagccctgtccctatggcaactcaccacactattctcatagtgctgggtcatctcattgacaagcttatccaattgcaggctgcgggagccaacgatctggatccagaagtggttagggtgctcagaagcagaaacgtagacttctaggtactcatcagcatgaaaactgaagtcaggactggggactgaacacagagataaggatggtggccacatcagacccatctctggttggaatgaagagactaaccagggtagtgagaggtacaaataccaatggctgttaccattttaaaatggcaggagaggcaactggatgaatcaaacaagaatatcctaaagaaagatactaagctatcctttgtacctttccatgtaactgagtaataacagcttacattctttgtcatgtgctacatagtcaaatcggtcaccaattatacagaaggtaaacctccatatgctagctacagcatggatcagtaaaaaggtatatggacagcaatctttacatggacagtgacggacatggacctgttccagatcccattctaccactgactctttacatgaccctggacaagtctgtgagcttcttgggaatccaggtcctctttgcccacgccaaaacctatgtacagaagagaaagctcacagccttttcaatagtgatgatttttaaaaacagtaatgaaaaaggcaatataaaatctggctgagaattttacttgttgataaagtatgtctaggctgggcatggtggctcatgcctgtaatcccagcactttgggaggccaaggtgggtggatcatttgaggccaggagttcgagtccagcctgtccaacatggtgaaaccccatctctactaaaaaatacaaaaatcagtcggatgtggtggtgtgcacctg

SEQ ID NO: 12448 - DNA, 21950 bp, Homo sapiens
tggatgagtttgatagactcactcattgtgctgactggaagcctctggtagccaagatctctagctatgtccagactgggatctcaacttggccaaagatctacttatatgatactagcaatgggaaggtaagactggcattcactcactgcttgccatatcttcagtatatttatagcctaatttactttttcttcctcagaaacccttatctgatattactcttactgtaagatccttctcaccatctcaccaaaggaatgtctttaaagtatcagtccttctgccttgtttcctcaaatttgcccttgcttactgagagaacatcattcccttttcatttttcttctcagaaacttgatattgggctagaattagtacacaaaggatacgcaattgagcttcctgaagacatagaagaaaacagagctgtcccagacatgttgaaggacatggtgagctattgtagttatatagggtgctgcttccaggcaaatctagcacatagacactaagggcttctagtcctgatactgtgttagctttcctaaggactttgagctcctccagtagttgaccaaaggagcattttgtccctcttggtagccaaatgcaactgccttaaccaggtcctatgagaagaatgaaagggtggcctcttttttcctaaaagccaacatgttcctccttttttcctgttttcatccactcaggccacagaaacagatgcctctctcagcacgttgctcactgagaccaaaaagagctctggagagataacacataccctgtcctgcctcagcttatcaggtacaagcagtatttcctccctagagcatctttggagattaacttttctcattcagtctttccagagtagggaggttaattgaaggcttggttcctagtcaggtcattgagtaccaagaggtccatttttcttttgagcctcgctggcattgcctgctagaatagggcagtgtctaactttctccttcttatttatcttcaatagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaccaaattctgattgaatcacaaggtggaagcaggctgtgagcctaaatctggtgaaaactgccaactgcctcacagaaaggatcacatctatgaaacaagtgtccctcccatatacacattcatattctttctctaaagtcacttcagaaataaccattcactggctgggcacggtagctcacacctgtaatcccagcgctttgggaggctaaggcaggcagattacttgaggccaacatggtgaaaccctgtctctactaaaaatacaaaaaattagccaggcatggtggcatgcacctgttgtcccagctgcgtgggaggctgaggcaggagaattgcttgaacctgggaggtggaggttgcagtgagctgagatcatgccactgcactccagcctgggtgacagagagagactctgtctcaaaaaaatacaaaaatacaaaatacaaaaattagctgggcgtggtggcaggcacctgtaatcccagctatttgggaggctgaggcacaagaatcacttgaacctgggaagcggaggttgcagtgaacccagattgcaccaccacacaaccttgtctcataaaaaaaaattcactaggaaccagaaccaatttaggtttaggctgtgtgagtaagaccccacctatactattcaaaagaaaaggcccagattaagattctagaaacctggattctaggagcagctctggtaagtagctcatgtagtcttggaggaatctttaaggagtagatctccactgtaaactttttgcaaaattttaacgtgtttccttatagcatctttctgacagtactgtgaggctcaaatgcgaggcttgaagtacttgaggtgcttgaaagtaaatataaatgtatagtaatgtggatggtagaaaaatggcaagtgaattttttttaaggataaagcaagataaactagaaaatttaaaactagcacataaggatgccttacacaggtcttttttttaaatttagggattagtaacgtctacctctatactacatggcaactatattttctcacaaccacaattctcaaaatttattttctcagaaaaatctcagtattagccaggcaccggtggctcacacctataatcccaacactttgggaggccgaggcgggcagattgcttgagctcaggagttcgagaccagcctggcaccatgctgaaaccccatctctaccaaaaatacaaaaaaattagccaggcatggtggtgtgtgcctgtggtcctagctacttgagaggctgaggtgggaggatcgcttgagcccagggaagcagagggtgcagtgagtgagccaagattgcaccactccactccagcctgtgtgacacagcaagatgctgtctccaaaaaaagaaaagaaaaatctcagtcccaattagcagaaaggctctagtgaaggaacagttctggtgagtagttcaggtactcttggaggaatctttaaggagcttccatttatttgatgtttcagatgttgcctgcaatgaactcgctgaagcatgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcctttaagtcttacctgtttacagcccattctgatgggttctttgtcattctgttagtataacccagtacttttcctgctgcctggaatgccctcttctatgttacctattctgtccgttgagatcccccaacttgggccaaagccaagagatctatgtgccttctctggttttctccacatctatagcacctcaactgaaatatatggataaaaacagcctaacaaagctcagtctttctgaactaggaagttcactgattagtgctcagtaaatggttagaataaatggggaaatagtttggggcatggaggaaggcaaagggaaccaaaaatccttaggtactttcctccgtagttcaggtccctgtgatcttttcagtgaatttagctctgttaaggtgtatatcccactccagtcaaccctattacccacccccccaagaaaccgtgaacacttgatgattgcactaccctttattcctaggatggaaagtgtcctgaatcacatcccgggcccctgattccatgtgtcaaggcttccagcccctcaaagcgttggaataagcatgttcaaggaggctcactgggcaggtggccaacatccctttcaaggggatacaccataaagatgacattgtccaagggagggagggcagggtgatctggtctgaccacctcaaagcccatgtagctgaaggcccgcagcagggcacctgtgaaaggatagaacaaatgattagaacatgctttaaaactcaatacatgtatgcccccagatttgatttcttccactagggagtggccctgggaagcagtgtagtgcaggcatataggatgtgctttagtccaacagacctaggctctaactctggttttaacacttgttctgtgagttagtcctgcagaacttcagtttccatctatagaattttccatttataaatcatagaaccttcctcctcacagaatttaagatgaaatgagatgttcatgaagtgcttaacactagagattagtgaggtctacctatatactaatacaatgatggcatagtaagctctgaaatagtatctatcacttatgaatggttattcaccatcccttatatccaacagagtttgagctccttgaggcaagaggctatagtttctgtaacatatgctccaggcatccggttaaatatgtccccgttcccttggccttatgtctgaccctttcacattgtaggtgctccatatgtttgagatccattttgtcctgctggccacatcccttgaatggattctgtgtaatttcaccagtgctccttcagtctggcccctaacaccacctgcaggggcttcctcagagtccagttgtaacttgatggaacaagttacaacttcccaccttcgtggtaggtgggaagaaaagaatccctgaaatgcctgagggtgcatttttaaagacaggggaagagggtctcctgtaaaggaaaaggagttatccagctgcctcagcgcgaaaagcaaggaagaacagcagatccccacctctgtcgttccgatcattctggaagttcacaaacacagagtccacatttgtcttctcttccacgtactccagggttgcagtcaaactaggagccacagaaaaacagttaaaatgtttggccgctccctctccctctccctctccctctccctccacggtctccctctgatgccaccaaagttgtgaaagccgaagctggactgtactgctgccatctcggctcactgcaacctccctgcctgattctcctgcctcagcctgctgagtgcctgggattgcaggcgcgtgccgccatgcctgactggttttcgtattttggtggagacggggtttcgctgtgttggccgggctggtctccagctcctaaccgcgagtgatctgccagcctcggcctcctgaggtgccgggattgcagacggagcctcgttcactcagtgctcagtgttgcccaggctggagtgcagtggcgtgatctcggctcgctacaacctccacctcccagccgcctgccttggcctcccaaagtgccgagattgcagcctctgcccggccaccaccccgtctgggaagtgaggagcgtctctgcctggccgcccatcgtctgggatgtgaggagcgcctctgcccggccgtcatcccgtctaggaagtgaggagcgtctccgcccagccgcccatcgtctgggatgtggggagcgcctctacccggccacgaccctgtctgggaactgaggagtgtctctgcccagccgcgaccccatctgggaggtgaggagcatctctgcccgtccgccctgtctgagaagtgaggagcccctccgcccggcagccgcctcgtctgggaagtgaggggcgtctccgcccggcagctgccccgtccgggaggtggggggcagcccccgcccggtcagccgccccgtctgggagggaggtggggggcagcccccgcccggtcagccgccccgtccaggagggaggtggggggcagcccccgcccggtcagccgccccgtccgggagggaggtggggggcagtccccacccggccaccgccccctccgggaggtggggggtgcgtctgcccggccgccccttttgggaagtgagcccctctgcccggccgccacaccgtctgggaggtgtacccaagagctcattgagaatgggccatgatgacgatggcggttttgtcgaatagaaaagggggaaatgtggggaaaagatagagaaatcagattgttgctgtgtctgtgtagaaagaagtagacataggagactccattttgttctgtactaagaaaaattcttctgccttgggatgctgttaatctataaccttacccccaaccccatgctctctgaaacgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacttgtttatctgctgaccttccctccactattgtcctatgaccctgccaaatccccctctgtgagaaacacccaagaatgatcaataaatactgggaaaaaaaaatttggccaactcagaatccagaaagacacctacttggagcagtaaaaatattattggtcgttttctgccctccacccacccaagccaggaaatgaaagttgctaaactagttttggtagatttttcttggaagccaagagattgcacatcactggatgtaagccacagaaggggtctggggagaaaggactactgagatgaacagctagaaagtacttcccgttattcaactatttctggatctgagtccagcttcccatggactcttatcccttgaaccccagatcctggctcagctcacaggcttgtctgcatgccaggtgaatggattgcttatatctagctccagaattagccttatgtactatgacatgatagaagggtgaaatcccctacctattccctccccattctcccatccaggctcagtcacctttcccggttgccttgatccaaggcctgatatgggatatccargaagagtcgacggtcacagagaaggccgtgccaatgggcagaggtctgggaggtaaggcggaagtgaaagtctaactgtactgggtcctggtggagcagggggtcagtagccagcaccgtcaagttcccagcctggaaaaggagtaaaaatgctcctctagtcttcaaatcagacctcaggcagatkggggtgtgtccgttgaagcaaggtgggcattgatggggagagcctgggagaattggagycaagatcttaaagatgcaataatatcccttagtcccaggaactaatagcctatgcctattgtggagttctcctttatatcaaacaatccagctgaggcagtattactgcctgttgacttcaacccaggagtacaataaccatttaggaacttagaaatgtttacatcagagagcttaggatttaaacaaagctttataatgtgcttcctttctcactaataatttccacttttttcattatatgggttttctctaaattcttctatttaaaatgccatggttacaaccaggcttgttattgcaatatgatatgtgggcaagttctggattccagatcctgcttagcatctttaagcaggatcttggcataaacagctttatgtcccagaagtcctacagagtttgttttacctttgtccccactccctcttttcccaatcctgattttcactaccatctgtatgaccttgattttacagtctgtgggccagaatgcttgtctatatagcaagtagcttttacacatgcgttccaagattccatctacctctgtaattcatcttccaacttgctaatgtccctcctctgcaaggtatgcaagaaaagggttgccctgtcacagcactagctcacagtccacttaccgaatacagttctttaagctggtcgtggttaccctgctcggtgcttttgccctcctggaggcctactagggactcaggagcactggaggcaggaacggggctggagtgtcaagtcctcctcttccttataagtgatgctggttgggaaagagacccaaattagtttatcttggaatctgaggtgggaagatacacagtaccaggctctggcatgatcttctgtattttctgttgtccagcctgtttctrtgttcctgggcccaaccagatggaaaaattctaaagttccatgccagctttccaccccctattctgttgttatttcttgccatttgggaaattctttcaaattcttttactttttccttacattttatataaacaactacaaatagagatgaaaacaagtaccttttataacaacgaggcagcatcttctcccggagagtgatccggtacttgtaacagtaaaggtaataggcgtatggtgaccagatcgggtagaggtagttacgtgtttttcccctcttgatataagaaagggagtagacagaggggcgacacctcttacaaggcagtttttcagttcagtgcctccctgtggcaaagtgaagttcacaggtgggtggcagaggtttaggcaacctggtggcattgtgacccagtgggcactatgacatggataaggggtcagcccttatgtcacctcaggactccactctgctgcttatctaccctaatcccttatccaaggctcatattcgactagtatgcatgttatggctgtatgaatgattaaaaaatagaacttgaagacttctgtactggttggccaaaagccctgcctgagcacttgtgcccacccaccctgctcctctgtggacactccccttcccccaaaatccagcaagtaaagagttggtatctgactcttccaaggctctgatccagtggtgacctgattagttggttcccagttcataccagttgagtatttttattatcatccctacccttaataacccaggatccttgtagggtaggaattgcaaactaattgtctaggccccttcaggggcctagacagcttatggaaattagtggagtggcagggtagggctgtagcaaaataggaaagctcacacgttatctaaaggaagtccacacaactcaattccatccagttccatgcaagaatgcagacttgatggtgctgtatcgtatgatttttgaacagaaactggaaagacagttttgtagtaaatctcaccaattttaaaaaatatcgactactgggccgggcacggtggctcacgtctgtaatcccagcgctttgggaggccgaggcgggcggatcacgaggtcaggagatcgagaccatcctggctaacacgatgaaactctgtctgtactaaaaatacaaaaaattagccgggcgtggtggcaggcgcctgtattcccagctacacgggaggctgaggcaggagaatggcgtgaacccaggaggcggagcttgcagtgagctgagatcgtgccactgcactccagcctgggcaacatagcgagactccaactcaaaaaaaaaaaaaatcaactactaaaaaattgttgataaaaaaacaacattgtaagcaaaatttggttctgggactgccactttgagacctctgcatatttatccattcaacaaatatttattgagggtctactattagccaggcactattctaggtgcttgagatgatacatcagtgaacaaaacaaatccctgccctatggaacgtatcttctaaaagtgagaggacaaacctagaaaataaacatagtaaattgtttagtatgttagaaggtaactgctatggggtggggggaatagagcaagataaaggaagataaggaatgtgaaggggatgggtcagggttacagtaagaaatagggtgatctctcactgaaaaaaactgacatttaattaaacacttggaggatgtgaggttgttaaccaagccagcatctgaggataagagcatccaacgcaaaagcagccagtgcaaaagccctgagcaggaaacgtgcctggtgttttcaagaaacaaggaggccactgtgggtggagcagtgtaaattagagaggagctaatggggtcagagtatgtatggccttgtagaccatctgatggcctttttcttttaccttgagtaaaggaggaagtcattacaaagttttgggtggaagaatgacatgatctgacttatgctttaaaaagatcattctggctgctataaataagctacatagaattataaactgtagagaattaagggatatcttttaggggactattgcagtaatccaggagaaagtagtgtcttattccaaggtagagcattggaggtggtgacaagtggctggattctggaaatacawgtgctccttgacttaaaatagggttatgtcctgataaacccatcgtatgttgaaagtatcataagttgaaaatgcatataatacacctaccaaacaccatagcttagcctagcctatcttaaacatgctcagacaacttatccgacagttgggtaaaatcatctaacacaaagcctattttataataaagtgttgaatatttcatgtaacttattgatgtcctactgagtgcacatcactttcacaccatcacaaactcaaaaattgtaaatccaagtcagggactatctgtaatttaaaggtagaacccacaggatttcctgatggagtatgagagaaaagagttagaatggaaagaatggagtttctgtcaactgagaggaaaaaggctgcagatggggcagttttgggggcgaggggggaataaataaattagtttgggacagttaactttgaggtgtcctttggatacrtaagaggaaaatgacgaataaacagttgaatatttgagacgagtttgggagatgtctaggatggaactagaaatttgggagtcattggcttataaatggtattgtaagccacgagactggatgagatcaacagtgagtgtatactgagaagagtaaaggttcaaaaacggagtcccgagggcattctaagaagcggggagaaaaggagaaatcagcaaacgagactgaagaagaccggtgtccaggaggccaagtagtgtatttaggaggaaggaggactggtcagtatgtttaagggccagtctttccataatctctgccaaatggaccttctttcatccagtttttatggtcttctgtccagtactgagaccctccccagagggaactgtcgcggccttaccatagttgctttttttyctacggtttacatagcttgtgatttagaattctcctttattagcttaaatactgcagtataatgattaagggtcaggctcctcctggagctggcagagttttccaagggatcccatcctttaccacttttaggtagatttgaagtaaggaaaagtgagagcatcattcattctccggtcagtatccagtcatcacagaacgttagaattaaaagttagcccagcaactggagctacagcaaagcccacactttcaagaggaagagcgtcttttccggcgtcagtccacctaacactcattccattatcagtcagtrattctaggcgtccgtcacctctgccaaaaagcaaaaataggcaagccgcggtgccatctgttccccggcccgctccccatactttcgctcagccgtaccggcgcgccgcaggcagcactggcgggggcctttcctgccgccgacgccggggtcctccctcaggtctcattctgtgcctgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcgggtgagggctgagtctggggtagggggtagatacgctcgagtattgtttctggaggcgcactgggacctggagggggccgatgtgggggtggcgggctttccttgaggggctggcggccgtggtggagggagagggtgttccttgtggagactagcttaccgtcgctttcctggccgccagggcacggtcatcgtggagcgctggtggaaggtaccgctggccggggrgggccggaagccgcgcctgcaccggcgacaycgcgtctataagctggtggaggacacgaagcatcggcccaaagaaaacctggagctcatcctgacgcagtcggtggagagtaaggcccgggccgaggcgcttcctctcaggctggtccggtttggcatcagctttttctagcccgtccccctcaactatttgccttgctttttctttgtggaaacaatccaactctatatgtgagaagaggaagccataaaaactattgtgattgtgacactggcctccagcattgaaaattaaaacataaaggcagcaacatcattaacagtgtgtggggagaggagcctgacaatttgtgccacagatactgaaatcctccatgggacgacaactccctctatacaggggatattaaatttatacatcaagttctaaagaaactaattagcagtctcttaaatcttgttcctagtgaatatgaattagcatttcttttaggaaaaataagcactgtgagaaactaagaggtgcttctctttttgacatcttttctttagggactcctagatggttctaattcccctgtctctgttctaattgacagatgttggagtccggggtgacctggtctcagtgaagaaatctttaggccggaatcgactccttcctcagggactggctgtatatgcatcccctgaaaacaagaagctgtttgaagaggagaaattggtgagctcaaaggaaggacagagagacttggggagataaaacttcttttctcttgcagyttccttccctttgacatttaacttaacttgaaaatgaaataggaactagaagaacaggaatgcagaagcccagccaatgtccaacataggaatagtttgatgstatttaacatgggctcatttttcttttactgcttttcatctttaactttcttttctagctgagacaagaaggaaaattagagaagatccagaccaaggcaggtgaggcggtgagtagaaacataaaaagtgtttatttgtcacaagacttaccaacctcaccctgagagtctccctgattcccttgaggtctcctgattgcagacccaagagtgggagaaaggggaagtgttgtggctgccccacaaaacaggtatggagacctcttgggagatccctgatgtgttgggtgaagtgccttaaagtaccaagggaggtcccaatctgggaatcagggaacccatggaatagtctgagatgaggrctctgccttcaaggatatttacrtacaagttggagagaacatggacacatgagaagataatcagtacaggcacccgccaccatgcccggctaactgttgtatttttggtagagacagggtttcgccatgttggccaggstggtttcaaactcctgggctgaagtgacccactttgggagacccaccttggyctcccaaagtgctgggattacaggcatgagccatcttgcttggcttgcataccctgtgaccctgacatgtttcctctcctttgactcaaactcataattcctttcagacagtgaaatttctaaaaagctgtcgcctggaggtagggatgaagaacaatgtcaaatgggagctgaaccctgaaatagttgcccgccacttctttaagaatgtgagtgagtgttcccaaaaaccactctacccctgaggtggaagctgcctctsgaaaggaggcctgggattgatccctttgttaggaaggggtgtgatcatccagttgtagttaaggaaagtattcttggttagtttgcaggaatatgggaaggaaatggctaaggactaaggatggtcacatagaatttgaagactgataggaaaaggtggtggtttccatttatttcctgtctacctagggaaatgctggggatttgtgactcactggagaattgttacttttgtggatgaagtggttttggcctcaagccctgtttctctttgtgaatctacctccctttctgagaaatcagaattgaatttctctactaccgtctatgaaggtgtatgcccttctctcccatggaatcagccagagtagacaccccagttttattcatccctgtgcagggaatcctgtaaccctctttatgaggttccctagagtggcagtcatgaaaacagagttcatttgagctgagatttttttttttttttttttttttgcagcttggtgttgtggttgccccacatacattaaagttaccagmagagcctatcacacggtggggcgagtattggtgtgaggtgacggtgagtgttttgcatactttcttttttcttttctttctccttttcccccactttttcctttttttcctttctcttaaagacagggttttgtttcattgcccaggctggattcaaactcctgggttcaagcgatcctcccacctcagcctcccaagtagctaggactacaggcgttagccaccgcacctagcacctacctctcccttttttctaatttttttttttttttttttttttttgagctggagtctcactctgttgcccagactggagtgcagtggcacgatctcagctcactgcaacctccacctcccaggttcaagcgatccttctgcctcagtccccctagtagctgggattacaggcacacgccaccrtgcctggctaatttttgtattttagtagagacagggtttccccatgttggccaggctggtctcaaactcctgacctcaggtgatccacctgcctcagcctcccaaagtgctgggattacaggcataagccactgtgcccagccctagctctcctttttctgactgggagaaaagtcagggtgaaaagctgggattaggtggtgctaaatcttacytacctgactgatctctgagaattcccattgttttgtgtgcaggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaagtaagtgttgcttactggtcttgagtagatgagacaggacatccaactgagatttccttgagtcacagaggtttgctgctaaaaaggaaagaagagaatatcttagactgcatcccacagttactgtggtatgaacaaattgtgctgaacaagttgatgatgtgtttggtcttaacacttactcttcttagatacattgatgtagtcatcaatgtgaataagcacaatggattctgcttctctaagacctgagtaaggcctaagggtaattgttggaaagctgggatgaaagaagcttaaaaagggaacttttttccttgaaccagctcctgaaattctgaaaaagaagttaccttaattttctagaccaagattaagatagggagctagtcaaaaggtaactctggaatggatgaatggatgtcttgatgggagataaacgaaagtagatagttttttcctttttctttttcttttttttttttttttttgagacagagtcttgctctgtcacccaggctggagtgcagtggcataatctcagctcactgcacctccgcctccctggttcaagtgattctcctgcctcagcctcccgagtagctgggactacaggcatgtgccacagcacccggctaattttttatatttttagtagagatggggtttcaccatattgaccaggatggtctcaaactcctgacctcatgatccaccctcctcggcctcccaaagtgctgggattacaggcaggcatgagccaccatgcctggcctgaaagtagatagttttctgtaagttcagagtttcattagtagaaaaaaacattcattttcaggtggattgtgccaaggtcactcaaatacaatgtgaggtcatgcagtttagggtagtaaagatgggatcattgactcctttgctatccataccagacattggtttctttcctatttgagctcacctaccactctgagtcagttaaacactttcatcccatctcagctaatgagaaagtctgtcatcagtagttgcactgataactatagccaacttcatacttgacagagctctgtaactcaagtgtggcactggcactatctgaaatttagcatttctcccctccccacccttttcttttcttttttttttttttttttgaatgggaaaataacattatttcacattagggagtaggcaggcatccagactcagaactggaattgcttcttggtggcattggggaccatgagcatgttgaagtgtaccatcttgctcatgctggtgcttacccaaccatgatgatgttgctgatctggacatccctgatgcaaggggatgggtgcatgaacatgttcttgtgcttcttgaagcaactgtacttacacatgtagtggaaatagtcttggtggatgatgttgatcttttgcatcttttatcttggtcaccatgccagacaggatccaccctcagatggagatgttaccaataaagggcaatcagtgtaaatataggtgccctcatagcctatttgggcatattgaagcccaaactgatttttttttttttttttttttttttgagatggagtttcgctcttgttgcccaggctggagtgcaatggcacgatcttggctcactgtaatctctacctcccgggttcaagcgattctcctgcctcagcctcccaaatagctgggattacaggagcccaccaccacgcccggctaattttttgtgtatttttagtagagacggggtctcaccatgttggccaggctggtgttgaactcctgacctcaggtgatccacccgcctcggccttccaaagtgctaggattacaggcatgagccactgcacccagccccagactgatcttatggtcctataggaacttctcattgccagtatctcccagcaggaccctcttgttttgaaagatggttgactgcttttggtaggtacactcagtcttggatttaacagaacttcctgaaaggtttgagcctccattaacttgcagagaccccagtatttaggaagcgctaatctagattgaagtagatgcatacacttctgtaccccagttaatccctagtgagttggggacacccagaattaacccccaaactgaagcacagagttctgccatcctggacacgctcctgaggtttggggaggacctgcagcctcggcatgagccccaagcccactgaaatttgccatttcaatgatccccattcctattgtccttgaaatggtaggctaattaaacacacacagcatctctcaacatgaccatcacgaaactctctgaaattgagcaacgagcacacatttcacacagctaaccttaaaaagcatttaaatacctgccataggttgagttcttggcaaaaacactctgtgttggagattcacatgcaggaagtttattgggaggagttatctgcatcaacacctattggggagtaaaggcagtagaattgggtagagggagaaattgagctgatgcagtcttaacaaacgcctcagtcaatcaggagctcaaactaggatggctctgcaggatgccccagtagggtaagtgggctggaccttatctccccacttgaccaggaaaggggtatgatcatgagtgaggtggctaacttcagccaaaggcggtccctggatgaggcacaggtgacagctgtcagcattcttagcagcttcagtcctcaaggggaaaatatgggcagcacaccacagtcaacactgcagtccaccctttgcactgctcagactgatttgtttcattagttctggaatggtttcttcaggattctgatggatctctttctggggaaacttaaaagaggaaggtctggaacaggccacagcctctgctgctgtagcttgagtttgcaactggcattcacctcccttctctactacctattgttgatctttccccaacccccttgagggggttgtacctctggttcacgtgggttaccagatgaggtacctggccatcatgcccttctcagactatgactgcacttgttcatttatcatcaaaattgggcaaggagaaacatactcaagtggatgatctgggtgccagatatattcttccctgtccccactgtgtaatagcagccccacctcctgataatgactcatttccttgccttgtttcttggtagtgatttggagtaatctagtgcctgccatagcttaaagtttagtgagattcagtgtgttcactggtgcaaatattccccttctgggaaccaggacttctaaacccttagagaccagagttgggatagaaggcacagtttcttcaattgggtcactgggagtgatgataatgcgggctgctcctacacccaccctttgttccccagagccatatattttccttaaggatacactattcaatggctattggtctcaggtatgtactgcatcatgaaggatgatgccttctccttacaggttatcatctccaatccggtgccttagctgtgcttttaacaagcactctatcagggagcagcttctgcatagtacggtatgtgattaaagccaatcctaccatcatgtgcccagcattgtacctccttgctatcaagtgggtctcttggtttgatgcaatgttacacaagatttcaggccaatggatcaaaattttgtaaacctttggatggtgttgctgaccgaggctgtgcaggcaggaaaggcaaaccagtacccataatatacatcagtgccccttcaaaatagaacacttccccttccaaggtagcaaggatacagtgtaatcaacttaccaccaagtggctagacggtttccttgaggaatggtgacatcaggctaagtgttggtctctgttgctggcaagctggacattcactgatgcagtagttagatcagacttgatgagtccatgacgttgaacccttgcatttgctccaccatggctcctccgttcattgatcactttgccagcattggggtgccagcaacaaagcctggttaacattatttggctaagtcattccatctgcttggttggtaccttttctgtggtggatgttatctgatgggaattaacctgcaatacaaaaatcatcacactgtatacccattctcgggtatgttatgttccttttccccacacttccttgtttttaatcttccagtttgccttccaggcccatgagtctatatatattcttacttctggcaggtacacaggccatctaagtggggccatagtgcagccacagtgtatttccagcctactttcacctaatgagacaaccagtacattaaccaagctcagcctttttcctcttctgtcatcaggtcatgagggatctccgatccatgtggctacagatgtaaactgagaaagcaccaccagtgcatcaatagtgggtgacagggcatctgggcacctgcttatgtagctcacttttgccttccagccctgcttgttcccaattctacatatgccactttcattttatgaaggatgaccggtcgacccacccagccttatgacttgtgggtttgacagaacccaggttataatacatcatgacttaacgtcccataggtaagcacattgtctcaactagtactcggtagcattccaggagctatcttttgaaaggtatataatgctctgtttcagatggcatggcattgctccagcactatagggggctgtgtgtgacttactattgggatttatcacgaacagtatatgatcttttctcaccactgacacctctaatataatatggtgtcttgtgatccaagccgcagggccatttgtaccacagtcttggcctgctacagagcttttacctgctctgggacccactcaaagttggcaggcttttgtgtcacgtatgatatttgtgtcaaagcaacatttccaagtatggaatatgctagcaatagaccccaagacatttgcaaggcattgtgctttttagtggtgagaaatacgagatgcaaaatttctccttatcatctttggagggaatgtcctggtatgcttcagaccactggacttttaaaaacttcactgatctggcaagatcctgaatatttgtaggattcttgccctactatttgaagaagatttatcctaccaaggcctctgatacaggtatcatttcaggttcatcctgtacaattaccatgatgtcatcagtgcagtaatgggatgtcctatggaatgtcctaatggtccaggtcccttcagactatattatgacagaggcaggagagtttacatggtccagaggcaaaactggaaatgtatattattgctcatctcagtgaaagcaagcttttatgatcttcctttctacaaggatgaaaaagggtgcattgtccagatcaatacataccatgtaggctgcgttaatcttttccagcaaagatatcacatttggaacagcagatagaattagcattatttgttgattgagattgcagtaatccatactcattctccaagatctgtctggttttagcagttgccagactagtgaattaaatggcaatatgatgggcaccaccacctctgcattctttaggtcttcaagcagggcactaatggagtaatttttatttattatattggtctggaatggtggaggcagttccagacacttcatgttggccttcctcactatgatatttcctacctcacaaaccaaaaaaccaacctggtggttctgccaactgtcaaatatgtctattccaactgtccattaaggactcatgaagtaactactaggtgagtctgtaaacctggtagacctactgagagtcagagctggagctggaatacaattattacctagcctccacaccctgcaactctaacagaggtccataatggagcttccaatcctagggtgtcaatgtcaatggactctatccaacagtgctttaaatgtttgcatagtcctctttctctcctgtgtcttatga

SEQ ID NO: 12449 - DNA, 16146 bp, Homo sapiens
acaggactggctactttgctacaatggcctgtctttcctgagcccagtggagggtcccaggggggcagaagtcattgataggggccagtagggttgtagagccactgtctgaacttctgtggaggtctggtgcaggggaggtgtgaacagataggaggctaggtgaggatgcagcagaggaaggggtcaggagtgccccaggagggggcggtaccgaggcagggattcagctgggtctgagagggaggcaaggctgagggggatggccctttggagtgggcagggacatgaccacagaaagcctgggaagtggaaacagacaggagcctgctggagctcttggagctttgtgtggggcactgggggaaggaggcaggcactccaccctgacctgcccctacctcggatgagggtcttctctgcctgttggatgatgtgctgcccctgctcttggaggaagaggcctcccagccaccccctcctgccagtcgccctgacctgctgacccagacagatctgctatccctacagcatccaggaaggccacagggagggggcccaggtggcatgggtttctgaggcctgggatctgctctcagtcccgctctcgccaaccccctttgcccctctgtgacagtgtgtgtacatatgcgtgcatgtgtgtacctgtgtggtgtggctcacaaggtcacccctgggggtgggataataagaggtaaagtgtgaccccctctcttccgtacattcattttttcaagcttgtgaatattcacattgttaatataatcttctgcagtcccatgacttcgaatagcacttagatgccgatgacccccccaccaaagaaaccccactgtctcccacagactccaggtctgtatctccaactgcctactcaatacaacacgtccacctgatgcaatgaacttaatgtgtctaaaccccaattccacatttccagtcctcctaccggctcctcccccagtcttctctactttactgtatgacaactccatttttcccaatactggttttaaaaaccctggagtagtccttgactccagtctctctcacctttcaaccaattcagcagcaaatactgacagctctacctttgctcatcaaagcatattccaaaatcaccctattcgagactgcacactgtcatctttcccttcaattacagcagtagcctcctaactagttttcttgattccactcttgcccatcagcagtaaaattagcacagtgcatttaaaatgatcttttaaaaatgacagggccgggcgtgatggctcatgcctataatcacagcactttgtgaggctgaggcggacgttattgcttgaggtcaggagtttgagaccaacctggccaatatggtgaaaccctgtgtctactaaaaatataaaaattagccaggcatggtggtgggcgcctgtaatcgcagctgctccagaggctgacaaaggagaatctcttgaaccagggaggtggaggctgcagtgagccaagattgggacactgcactccagcctgggcaacagagactttgtctcaaaaaaataaaaattggccgggcgtggtggctcatgcctgtaatcccagcactttgggaggccgaggcgggtggatcacctgaggtcaggagttcaagaccagcctggccaacagggtgaaaccttgtctctactaaaaacccaaaaaattagccaggcgtggtggcacgtgcctgtaatcccagctactcaggcggctgaggcaggggaattgcttgaaccccggaggcgtacgctgcagtgagtggagattgcgccattgtactctagcctgggcaacaagagtgaaactccatctcaaaataataataataaaattaaaaaaaatttaaaataaaaaagggagcctgggcaacaaagtgagaccccgtctctacgaaaaaacaaaaaaaatagttgggtgtggttgcacacatctgtagtcccagcttcttgggaggctgacatgggaagactgtttgagcccaggaggttgaggccacagtaagctgtgggcacaccactgcattccagcctgggcaagagagggagaccctgtctcataaaagaaagaaagaggccaggtgtggtggctacgcctgtaatcccaacactttgggagcccaaggccggtgaatcacttgagatcaggagttcgagaccagcctggccaacatggtaaaaccccgtctctactaaaaatacaaaaattagctgggcgtggtagtttgtgcctgtaatcccagctactggggaggctgaggcaggagaatcgcttgaacccgggagacgaaggttgcagtgagctgagatttctccactgcactccagcctgggtaaagagtgagactcggccgggtgcggtggctcatgtctttaatcccagcactttgggaggccgaggcgggtggatcacctgaggtcaggagttcaagaccagcctggccaacctggtgaaagcctgtctctactaaaaatagaaaaattagctgggcgtggtggtgggtgcctgtaatcccagctactcaggaggctgaagcaggagaatcacttgaacctgggaggcagaggttgcagtgagccgagatcatgccgttgcactccaacctgggtgacagtgagactctgtcttaaaacaaaacaaaagaagcaaagtttattttgctcagagcttcacagttttaggggctggaaagtgcaagaacctcatgcagtatctggcaaagggctgtcccaggatggaagggcagaaggtggaagcaaatgagagacacgaaattgggccaaatgtcgtccatccatcaggagccactcccatgataacagtatttatctattcaagagggcagagccctcatgatctaattatcttttttttttttctcctgcctcggcctcttgagaagctgggattttaggcgcatgccaccacaccccgctaatttttgtacttttagtagagacggggtttcaccacgttggttgggctggtcgcaaactcctgatctcaggtgatccacctgagatccaccactttggcttcccaaagtgctgagattacaggagtgagccacctcgcccagctgacctaattacctcttaaaggccccaccctgcccagtgcagtggctcaggcctgtaatcccaacactttgggaggctgaagtgggaggactgcttgagttcaggagttggaaaccagcccaggcaacacagcaagatcctgtctgtatgaaaaaaaaaattttttttttaattagccaggtgtggtggcacacatctgtagttccagctgctcaggaggccaaggcagaggactgcttgagcccaggcagttgaggctgctgtgagccatgatcaacccactgcactccagcctgggggacaagagtgagaccctgtctcaaagagaaaaaaagtcccatctcttaagacagtagcaattgaattttttatttcaacatgagttgtggcagggacattcgaaccatagcaccaaggttctccccaaagctctccaagaccttctttgatctggttcctgccccctttctgatctcatctcccaccaatctccatctacatcacccagttcagccctcctgcctcagggcctttgtatttggccccctctgggtcacattccctgatctctgattctatgtcttccttcagatttttgctgttttcctgaaccaccttatctaaaatagcctctcagcttctccactatagctcccttactctgctttacttttgttcttatcctttatcaccagtagatatattatggatttgggttttttaatttaatttttattttttttggagacggagtctctctgtcacccaggctggagtgcagtggcgtgatctcggctcattgcaatctctgcctcccaggttcaagcgattctcctgcctcagcctcctgagtagctggaatcacaagtaccgccaccacacccagctaattttttgtatttttagtagagacggggtttcactatgttggccaggctagtcttgaactcctgacctcaggtgatctgcctgcctcagcttcccaaagtgctgggattacaggcgtgagccaccgcgcctggccatgtattatagatttatttatggtggcatgattcctgtctgcaaccccaagacacacagtactctataccccaggatggcagggacattgttttgttcactggtccatccctgtgggaggcactaaaatacacatttactcaataaaaatgactctgtatgtggtgtgtcagactgtgtgtccagatgtcttgggacattctctggcagcctttgctgtttgtgtcttcaaatcagaccctatctttaaatctaacatgtctcctgtgagaagcctggtcccttaatacctttgtggctctacaactcttccctccttgactgtatctcttcctccaggtctttgctgttttcctgaatcaccttatctaaaatagcatctccttttctccatcataagcccaggttttgtggggctgggggcttatttgcttttggagaccgtcttcaagaatacaaaagataaacacaaaattacatataaaagtgagttttgtttttttttttaagtttcggaaaccacggcacattactggaatcttggagactggcttctctcccttttgatctccatgcacaacttacctgagatgtattctaatagcaacctggcttcccctccacactcagcctttcaagcgcccattagcttcgcagtaaatctcccacactaggtatccagcctttgcctttttcttttttctttttttttttccagagggagtttcgctttttttttttttttttttttgagacggagtctcactctgtcacccaggctggagtgtagtggtgcgatctcggctcactgcaagctcttcctcccgggttcacgccattctcctgcctcagcctcccgagtagctgggactacaggcgtctgccaccatgcccggctaatttttttttgtatttttagtagagacggggtttcaccgtgttagccaggatggtctcgatctcctgacctcgtgatccgcccgcctcggcctcccaaagtgctgggattacaggcgtcagccaccgcgcccggccgggagtttcgctcttgttgcccaggttggagtgcaatggcacaatcttggctcaccgcgacctccgcccacgggttcaggcgattctcctgcctcagcctcctgagtagctgggattacagccatgcgccaccacgctcgtctaattttgtatttttagtagagacaaggtttctccatattggtcaggttggtctcgaactcccgacctcagatgctctgcccacctcggcatcccaaagtgctgggattacaggcgtgagccaccgcgcccaatcagcctttgcctttttctcctgtccacagagaccccgcaaacaagcgcatcagaggatctgggtggtgcgagagcctcctacagcagccaggtacacacaaggcctcagtttttccatctgtgaaatgggtacgtggacagacctgtccagtagcctcccatgtgagaatcctcggactgagagggtactaggagggctaatacagcgcagccctgtgattccccacctctgtccctggaatgaaggaaatctgggtgttagttctggctttgccgatgcctcttgggtggcctggctgaaactaatctctcctcatcaggccagaagggaatctgtgaaatgggctttgaaacctgccttgcctttctccgcccggtcccagcgggggtccgatcggcatcaaggattcacccactcccagagccttcgggatcagccccaccccatcagcaggacacagcccatgccactggaaatctcgcgagaatcccgcgctgaagcgaagtcgagacgtttgaccttcctccgtttccgtagttccgagttgcggtttctccgttagtgcttccgrgttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtycctgctccaggcctccttctctgkggtccaaggtcccatacaggcctctgcctcggccgcaggcccttcagtcaccgtcgcctcgtctccctgactgtccgcaggcctgggcagcatggccgtattccggtcgggtctcytggtgctgamgacgccgctggcctccctagcccctcgcctggcctccatcctgacctcggcggcccggctggtgaatcacacactctatgttcacctgcagccgggcatgagcctggagggcccggctcagccccagtmcagccccgtgcaggccacgtttgaggttcttgatttcatcacgcacmtctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagtgagtaagagggaccctggactagggtggaggatccccaaatctccccacccccgacccttatgccgagatcaaggaagggtagggccattcattacttcccacccttcccaaatgtcacagtggttgacactcaattggtgctaaggccattttgtcaaatgaacagctttctcagcatgtggtccagtcaccactcaatcagaataccccaaatgtgaagcaaaggkatctgcattttagcaagttttccaggtgatacaccctaatgagacactgggaatgaatgggtgagtgagctgcaggtagcagtgccacagacaggaggaggaaactcaagcatggcatgggtcttggaattttccatctgcctctgatgccctctggcactgctcgttctctggagtggtttcctggtggcttattctctggacacatgccagcccttggagtgactattgtgcttgcctgtttcttcaccttcatgctcccctcaccatcaccataggccttaccagttgaaccctttctgccaccccctctggggatactgtacttagggacactttttcccaaactggcccatactctcctccccartaaaaagatctcactgttcttctgggctccttccccaggcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgtaacccctgagggagactggcagagggagtggatgggggayggggaaggccattttgagggggctgttggaagtaccatggccccagaggagagaagtgggggctcagggtggtgggaagaagcaaggaggaactggttctcagtttgcccgctgagtcggaggaggaggagcctgggtaggaaggggaggatgggggggcaggttggatgtcagggtcttcctctcactccctccttccctctttttaccctttcctctttaccccaggacctggaggaacttgctttgtaccagatccagctgctgaaggacctcagacatacrgagaatgaagaggacaaagtcagctcctccagcttccgccagcgaatgttggggaacctgcttcggcctccatatgtaagctcctctccctccttccctcctgcttggtgtcctggcaatgctggagagtagaagctgaggggctcagccccaggcatgaggctgagggccccagtaactgtgggttccctttcacctatccccaggaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacaggtaataactggggaaggctgaaagtggcctggagtgaggagctagccaggcctctgtgctcagttgtctgtctgtgttgtccagatattctccataaagatggcatcatcaacaggaaggtcctaggcagccgggtgtttgggaataaggtaaacaataacttcctaagggctcctaagccgctactagacccaggggtcagggtccagtggacctctctggtctggcccagaatgccatttccattgatctgttcccaacaccaccttgctcgggctggctgcctcttctagagaaggtaacctctgccctctgttcccctccccagaagcagctgaagatactcacggacattatgtggccaattatcgcaaagctggcccgagaggagatggatcgggctgtggctgagggtgagtgggagggaggatggcaacagctaaggggacagttaagctgtttcttcccctgggagcttccctgcccaacgtgggactgtctgttcaccctgggactgtgttctgcctgggagaacgtcggcactgctggcggtgactggggtctycccacaggaaagcgtgtgtgtgtgattgatgccgctgtgttgcttgaagccggctggcagaacctggtccatgaggtgtggactgctgtcatcccagagactgaggtatctcgccccaccccccacaccatccctactgcagatcctatcctgtgagctggaattcttcctgacaaatgtctcgtctgtgstcaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggttggtgcccagggcaaggcygggttgtggggaaggagtctccagtgggtactgcctgaccctgccctctcttcctcccaacatcctggcctgtctgaaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgagatgttgcttgtatggtgtctgcttcctgttccaatgcccctaagtatctttgggatccttaagccacaagtgcagggcccaggcctgagctggaagcctgggcaatgcagtggttaagagaatggcctttgaggctagccagaggcgagctttggccctcccactgaccagctgtgttcttctgagtaaggtgtagactttctaggtactgccgtgttttattgtttttgttttgtttttaatatgagaggccgcataacctagctagcaggttctttgcaagggttcattccacatgcatcctgccagacactgggctgggtgttggaagatcagccttccgcgcgccaggcggggcctctgccctcacagagcttgcagcctggtggggtcggacgatgtggctgggggcttctctgcccggttcctgacacaccggccagcagtgcaggtccggtgagcgcggggaggccgccctcagggtaacgtggggagccggccggccggacagtgcgcgtgcacacactatctgcggcggtgtgctgacaagccaattgaggggactccatcttacaaaacgcgcttcatgtcgccgccattccactgcctaacccggggagggcaggcacggcggggagcagtctcgaaggaggctggcgccaggccaagcgccgggccttgacggctggaaccgtggagtaaagtctttgggctgcgcatgcgcgatgcttcgccctgccccacctctcggtcgcggattggcgggcgcgggtcacgtgggcacgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggggagacaaacgaggcgtgtgcgcgcgagtcgggggaacggggcactggggtggagtaggggcggaagggatcatacacaggggaggcactcgcacgccctagcctgtgccagtctcgggggactcattaagctgcccgcgcaccccgggctgtgtgtgtgcaagcgcgcagggtgacagaggcgccttcccggaatggggggcgcgctgtgcgtgcctgcagtggaaggggcgcctccccctaggggcggaggtctgacgggcccttcccgtgctctgtgccgcaggtggagtatgcctacagcgacaacagcctggaccccggtgagtagctgccccatcttaagctctagagggacactcccgcccaggctctctagattcttgtggcgttgccaaccacgcctgagcacagtccactctccctgagcagagttcctggcttgagacagcaggagctgaaggacaagggcagaaaacaactgagggtgacacctagttccctctgctctggaacagggaagtggtggaactgatcactcaccactcagtggagcagctgatcactcacaccctcatcacgtccacatgcccgtttgtgagccaggggggtatcatgcaggcctatggagcagtgtagacactagggagcagagcactgcagcgtggtctggcaggaagtggggggcccagtatggttggctttgggttgaagggaagaggtcagcatttaagaaagccattgtgtggccgggcgcggtggctcacccctgtaatcccagcactttgggaggccgaggcaggcggatcacgaggtcaggagaccgagaccatcctggctaacacggtgaaaccccgtctccactaaaaaatacaaaaaaattagccgggcgtggtggcgggcgcctgtagtcccagctactcgggaggctgaggcaggagaatggcgtgaacctgggaggcggagcttgcagtgagccgagatcgcgccactgcactctagcctgggcgactgagcgagactctgtctaaaaaaaaaataaataaataaaagaaagccattgtgtcctacaggtgtctgagggtctggcaatgttccccaccccaccccttagtgattggggcctctcttttccagggctttttgtagaaagcacccgcaaggggagtgtagtgtccagagctaatagcatcggttccaccagtgcctcttctgtccccaacacaggtaggcagtaacatcccccccgacctcagggggctcagatatgtcataattgtagtacctttcctagacagggaagccccagccatccacacaggggtgctggagccaaagtatcagacacaaggtctcaccatctttcacctcatctggaacattaggtggttctgtccatctgccttctctggacaccaggttcttcccagctggggaaaggtgggctagctggaccccactgggccccaagatgacctttccctgcccccatctctgagcgtagatgatgaggacagtgattaccaccaggaggcctacaaggagtcctacaaagaccggcggcggcgcgcacacactcaggctgagcagaagaggagggacgccatcaaggtgaacagggaggcctgtgcctcagccagtgcgggagggccctgcatagtttagcttccctgtgccctgacccactcagacagtcccaggcaccctagggggtgggcaggtagtatagtcccaggcacaaacacctcccttgcagccttcccaccccattgagtttgtgagcatagaacttggtgtcatggaggaactttgtgccattttgctttaatctctcagggttaaagaacccatttcccctgctgtttccacagagaggctatgatgaccttcagaccatcgtccccacttgccagcagcaggacttctccattggctcccaaaagctcagcaaagccatcgttctacaaaagagtatggctagggaaagcactggaggggatggagccaagaggggctgtgaagaggccagtgcctcctacccacccatggctcggccttggtgtggtgattgccatgggatagttggggtctggggtaaggggaacaaagtcagccttatcttcttggttgagaatacttctgtacctgtcctttttttcttgcccccaccctagccattgactacattcagtttttgcacaaggagaagaaaaagcaggaggaggaggtgtccacgttacgcaaggatgtcaccgccctaaagatcatgaaagtgtaagaggggtgctgaatggggggaaccagaacttctgaggcaacttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggagctgctgcagcacctcagccctggcctgcatgcttttaggaactatgagcagattgtgaaggcacaccgggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcaggtatggggcaacaataggcacagggtctgcggttttctctaccatcaagcaaagtggcccaagccatcagctgttgagaaaagcgtggcagctgcttttagatcttaagggcgtttctacagctttgagggccctggtattttcccttttctttgctgtctaacccacatcttcatgttacggtttcattcggcaagtgtgacgtgagctcaatgtgaagtccagctcttggcttttgtctagcccatgttatcgctgcccctgtatggaagccccaggcatctgcagcagaattggaaacgcaaattctgggaccctacctttaggccccctaaagtagttgccccaagagctttttaaaaatttatttataatggagatgtgctaatggtattgcactaagtcttctaattgaagtctggttgctttttctgaggttttaaacttgtgtctgagatttcttgtttgtttctcaacatttttttttttgagacgggagtctcgttctgtcgcccaggctggagtgcagtggcacaatctcggctcactgcaacctccgcctcccgggttcacgccattctcctgcctcagcctcccgagtagctgggactacaggcgtgtgccaccatacctggccaattttttgtattttttagtaagacggggtttcaccgtgttagccaggatggtctcgatctcctgaccttgtgatccacccgcctcggcctcccaaagtgctgggattacaggcatgagccactgtgcctggcctcgtttcccaacatttttattgtgaaacacattaaacatattgcgatgttgagaggagttcacagtgaacactcgtatacccgctccctaaattttaccgaaacattttactatatttccatctctccatcttgcttcaggagcacctcaaattaaactgcagacatcagtacttcctgggggctttttttttttttttttgagacggagtctcactctgtcaccaaggctggagtgcagtggtgtgatgtcagctcactgcaacttccacctcctgggttcaggcgattctcatacctcagcctcctgtgtagctgggattacaggcatgtgccaccacacctaatttttgtatttttagtagagacggggtttcactatgttggccaggctggtcttgaaattcaggtgatccacccgccttggcctcccgaagtgctgggattataggcgtgagccaccacacctggcccccggggggctatttttaaagcacttttctaaagtacatggctgatctaggcaggcatcttggaaactactctgcgttgacttgggcattgtctatttcttcctctgctgccctcgccagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgc

SEQ ID NO: 12450 - DNA, 42174 bp, Homo sapiens
agatcgatattgtttgtggcttaagaatgcctttaagtggttttccgccctgggcgggctaggtgttccttgccctcattccggtaaacccacaaccttccagcatgggcgttatggccatcatgaacatgtcccagtgctgcagagattttgtttatggccagttttggggccagtttatgaccagattttggggggcttgttcccaacaagtgataatctactaattaatgtatctgaaatagtttccatcccttttccatctcctagttactagtgcttccttgcatcattcatcaaataaacttcttacattcaaattcttgtttctggttatgcttctagagaatctaactaaagcagtggacagttagacatgggataaagagaggagttgagaatggctacaaaatctttcatataggctttttagaggtgttattaacattaatcataatgaaaaaagtatgtattttatattaagatgttagataactgaaactgagataactgttagacatattcagcagacagttgaaaatatgcaattgagaccaggtgcagtggcttacatctgtaatcctaccacattgggaggacaaggtgaaaggattgcttgagctcaggagttcaagaccaacctaggcaacatagtgcgaccttgtctctaccaaaataaatttaaaaatttgctgggtgtggcgtgtacacttctagtcccagctacatgggaggctgaatcaggaggactacttgaacccaggaggttgacgctgcagggagctgaggtcattccactgcactccagattggaaaacagagtgagaccatgtcataaacaaaaacaaaaaaaagaagaagaaaagaaaaagagagaaaacatgcaattggacatcaggagagaagtaaagactgaagataagggctaggtgcagtgcctcatgcctgtaatcccagcactttgggaaacggaggcaggaagatcgcttgaggccaggagtttgagagcagcctggacaacaaaacgagaccctgtttctacaaaacaaaaaaaacaaaaaaaaaacaaattctagaaagactggagataaggatttagaagttattagtgttattagtgtatataggcaggtgccaaagccatggaaatggataagatggccaaaatgcaaatgtacgatgaaaagaccagaaagttaaggataggttttttctgagacagagtcttgctctgttgcccaggccggagtgcagtggtgcaatctcggctcactgcagcctctgcctcccgggttccagcaattctcctgtctcagcctcttaggtagctgggatttcaggcacacgccaccacgcccagctaatttttgtatttttagtaaagatggggttttgccatgttggccaaactggtctcgaactcctgacctcaggtgatgcacccacctcagcctcctaaagtgctgggattacaggtgtgagccaccgcacccggccaaggataggtttttatgaaacattaacatttaagaggttagatgaagaagaaccaatgaaggagactgaaaaggatagaatccccatttggctctgtccttggatggaacacttaattgtgggcactttgttgattatttaaatttctagtccatttgcattatgaaggtacattttcttctaagacttactgagtctgttacactggctcaacaaggaattaagatatagtttgatatgaggaggaaagggcttgagaaaggaactgatgttggttaaatgcttaccatgggctagaccttgtacatatatcatctactgaataattacaacaacctgtcgtgtgggagctagcaccttgtgttacctttaaagaaagtgaagattagaaaagttaagaaatgtttacaagtttccacatttatttattacattgaggagcaagaattcataaaccttttcaactccaaaactcatgctcttgtcattatattatcaactgtaccaaaaaactcgatgaaatgtagcctattgtatttaatatttcctttttcttaaaccagcaaaagaagtgttttgaaaaaccatgcttttcaaatattttgattgcctgacttattgcatgtataatgaataactcatctccattaacccacttaaattaaggggtttaatgaaccccttaaactgccagttagaacttctgattcatttaaggtaaccactgttaagaattaaaataagtgggctgggtgcggtggctcacacctgtaatcccagcactttcggaggccgaggcgggtggatcacgaggtcaggagatggagaccatcctggccaacatggtgaaaccctgtctctactaaaatacaaaaattagccaggcgtggtggcgggcacctgtaatcccagctacttgggaggctgaggcaggtgaatcacttgaacctgggaggcagaggttgcagtgagctgagatcgagccactgcactccagcttggtgacagagcaaggttccgtcaaaaaataaaataaaataaaataagtgagagacaatataaatctttaaaatatgctttgtctttgacctagcaattccacttctgggaatttactgcaaggaagtgataaagaatgtgtgcaaagacttagtgataagctaatcacgatattgaaaaattggtaatggcttacatatctaataataaaatatagttgaataaattagggtatgtcccaaaatactcagtagtcattagaagtaggctaatattgagaggtgacagcgtgctggcagcccttgcagccctggctccctctcggcgccccctcggccttggtgcccactctggccacgcttgaggagcccttcagcctgctgctgcactgtgggagtccctttctgggctggccaaggctggagccggctccctctgcttgcggggaggtgtggagggagaggcgcgggtgggaactggggcttcgtgcagcgcttgcgggccagctagagttccgggtgggcgtgggcttggtgggccctgcactcgcagcggctggccggccccacttgccccgggcagtgaggggcttagcacccaggccagcagctgcagagggtgcgccaggtcccccagcagtgctggcccactggcgcccaagggctgaggagtgcgggcacacagcgggactggcgggcagctccgcctgccgccccagcgcaggatccactgggtgaagccagctgggctcctgagtctagtggggacttggagaacctttgtgtctagctaagggattgtgagtgcaccaatcagcactctgtgtcttgctcaaggcttgtgaacacaccaatcagcaccctgtgtctagctcagggtttgtggatgcaccaattggcactctgtatctagctaatgtggcggggacttggggaatctttatgtctagctaagggattgtgaatacaccaatcggcactctgtatctagctcaaggtttgtaaacacaccaatcagcaccctgtgtgtagctcagggtttgtggatgcaccaatcggcactctttatctagctaatctggtggggacttggagaatctttatgtctagctaagggattgtgaatgcaccaatcggcactctgtgtctagctcaaggtttgtaaatgcaccaatcagcactctgtgtctagctcagagtttgaaaatacaccaatcgacactctgtatctagctaatctagcggggacttggagaacttttgtgtctagctcagccattgtaaacgcaccaatcagcaccctgtcaaaatggaccaatcagctctctgtaaaacagaccaatcagctctctgtaaaatggaccaatcagcagaatgtgggtggggccagataataaaagcaggctgcctgagccagcagtggcaacccgcttgggtcccgttccacagcgtggaagctttgttctttcactctttgcaataaatcttgctgctgctcactctttgggtccacactgcctttatgagctgtaacacagcgaaggtttgcagcttcactcctgaagccagtgagaccacaaacccaccaggaggaatgaacaactccagacgcgctgccttaagagctgtaacgctcaccgcaaaggtctgcagcttcactcctgatctagcgagaccacgaacccaccagaaggaagaaagtccgaacacatccaaacgtcagaaggaacaaactccggacacgccgcctttaagaactgtaacactcactgcgagggtccgcagcttcattcttgaagtcagtgagaccaagaacccaccaattctggacacaatatgaatatggaaagttgctcatgagatagttttaagtgaaaaaaatcaagttagcaaaataagtgtggtccaatttctggttatattccttagctggaatataaacactgctagtgtgggctgtccattgttgacatcgctccctccacctcccgtgtgttcgcattaatttatatgcgttgtggcttttgttctagctgagaggagaagaggtatagttggtacaagagatgaggaggaatgtggagaaatatggtgagtgcagtaaggaatctatttcctgcctcacttctcatactgggttgagcccctaggctttgtgaatgacagctggaaaggatggaagtgtttcattttttaaaaataaaaatatgatattgtaattttggacaaaggagtagggaacaaagcccaagaaagttcaggaaagaattgtgagattttgtgcatatggagcagtaactcctagaccagatgtcaaagactgccatgaagctggagaggagacaattctccccatctgtgtggtggaggctgctcaatgtcccccaatttctcttcatctcatcttgcttattaatacaatttcagttaggcactcagctgacaggactatgtttcacagatccccttgcagctaggtgtggctttgtaatcagatggaatgaggggatatgattgtagaaactggagcagccatcttgaatgaaagatgcaaggcaagctctgatgatggcagagtcacgagataaaaggagcctgggaccctgtcacaggacagagctgccagcaataccgtctctataacaaacactaaatttaattattcatatctaaatctgaacataggcagtaatttctaaccagtgtttagcccagcacaaggcctgggtggtagacttccaataaatgtagaattaagtttattcacactatatagacttattgcaaggcaagaatgagaccttagactttcgtgctcaatcttgaagacaatgtttttcaacccttttcaacagattctctctcaaaacctaaaatctcatccaccatcccactctctttttaccagggagatgtgtttctcaactaaagaaatagaagaaagtgtgttctctacgtattgtcagttagctaattagagcagaatgctggtgatgccaaaatctgtagccccatcccttatatggcatttgagaggagcgagtataaagcagtagataataccaaaggttttggcctcagggccgcagttatctctcctttgtgagaccttgggggcactgtttaacctctctgggtctcatccaagaaatggaaatactaataatactccatatggttgttgcaaggatgaaatgagatgtctgtaggaagtgccgaggaatgcctagcacaaccaagagcttgttgaacttgtcacgctttactgtcgataatgtgcattaagcaaacgctagttttatttgtttatttcatcttctaagtataagaatacattgtagctcgacattttggcaccagcccctaaagcattcccaccaccacccccgctgcgacaaagccctgcgctccttacgacagcgtacgacgccgagcctgacaggaacgcctcgtgcggtagaaccgcgcgggccaatcgcgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaaggtgagggccgagtaggtgaggtcgtgttgagccagaggcacggaaggtcccgctcagtgggtccggtacgcggcttaaccgtgttgggctggcggaggccgggcgcctgggccgcaccacccctggccccgcctctgcactggctcagcccggccctgggctccgaggtggccgctcatcctgcagcaggcgagggacgrggctgggcccaggctgtggcgagtcctttcgggttgtgtgacggccggcggtcacacatgccacacccccaagcctgggccgagggccatcccggtcacacataggcctctaccttggaggaagtgtaagccacccatgtcccgtatagtctggctytttataccatttgcctttttctcatcctaattctgatccctgagtggcctaagtttatgcagtgggcaggtaaccctggggtcacttcttgaatggtttagatccagtcagctccaacagatagccctcggaattcccctaaggtcttgtcagtgttggcagctttcaactggtgttcattgccatctctcacgacttcctggaggcttaaatctttaattgcagcaggttatcagaacaactctcctttttaatctgcttaccagatacagccaaattgtgtgtatgtggcaccgtggctgggtactatgttagtggagaccttaaaaataatatagcgatcaaacccttttgtttcagagatgaggaacctgagttctcaaaagttaatgtaacattctgcaagtcatgcttttagggagcggcggaggtgggactgaaactcaggattgtcaatctgctgctttttgggtttgctgtcctgacctcaaatgttaagagttgccttggaataggaaacatcagtgtaggttttgtcactgccgcccattttcctgctgtgagcaggggttatttgcttgcttgctttctgcctcattgcccttaggaaatggtagccgtccacatatagagattagggagattatgatgcaatttgtcaaactgtagtagcaccagaacgtaagtacattacttggtgcattttcctaagttaccttgtctaatttgctattcctagttgatgtctcaggaacatcttcatagattgttctaagtaaatacggactgtatatacacgctagcttagagttaggaaacaaaaattacaggtaaaaagattatcatgtatagattattcaagtatttaagttagaactttcagagcwttatttatttatttatttatttatttattttgagacggagtctcactctgacatccaggctagagtgcaatggcactatctcagctgactgcaacttccgcctcccgggttcaagtgattctcctgcctyggcctcccgagtagctgggattacaggcacccaccactacacccggctaattttcttgtatttttagtagagtcggggcttcactatgttggccaggctggtctcgaactcctgacctcaggtgatccgcccacctcagcctcccaaagtgttggcattacaggcgtgagccaccacggccggctcagagctttatgacattaaaatgatccctggcactaataattagccatgttttctgaaaattgaataaaaataccattgaatacgtttttaaaattaagttaaatatgagatgatttgttgactattgataataaaaagatgggtgtggcaagctgaggctgaaaaatttaaatgattagttattgtcaaagaggggatattgatctgtagcttctgtgtggcaatggaagaagatacactaataatcctcgcttgatacgtttgcccaaaattgttctgttatcatcaaccttcagtagttctatgttttgaattcatatcttacataatagggacattttctttttctagagaggccatttcaatcgaatatctcatggcctacagggactttctgcagtgcctctgagaacttacgcagatcagccgagtaagtacttaagtaaaacatttttttcatcacattagctgacagttcctttctatttcaatgtaaaagcaagtgaatattggaataacttatgttaagtgtcttatagttcatttgttcatgtatttattcgtttgaatgtatattgagctagtgtgttccaggcggtgaacaaggtaaaaaaaccctgctcttatgaaacttgtaatttggtgataaaagacaaacaatatataagtaatggataaatattttgggaagtaactgaaaattaaagcaggtaatagggaggaagagagataattttagatacagtgtcaggaaaggcctttctgaggagatgatgtctgggcagggtcctgagtgaagtgggggagtgaggttacttcaggcagagggaaacaacacygagaaaggcctgaggtgggacttagcttgtgaagtttaaggagtaataagaaggctggtatgactggagcagaaacccatgcaatgtaaagtcggagaggtaggcaggagacagatcatggagtgccttgtaaggcaggtctagtagtttggattatactccaagtatgatgggaaacaaaggttttgagcagggcagcaatttcatatgtttacatttaaaaagttaattttgtccgttgagtaaggttgtattggttattttaacactgtttagaatgatgagatgactttcttgacatcctgaatgaaagtcttcatgggtttatcaaaagcatgttttaaagattagcaggatctaaaaggaagctatgggtcatggaattttctcctgtgtactttttttatatttttgaagttcccataaaggatatgcattttatttttttaagtatttaaaacagaaagttaataggattatattgaagtattttgacctgtcagtaccaaggatattgattatttgcaatgtactgttttgacatttactgaattcacccatatggattataagtaacattggatgtcttaaagcttcagttatagaaatcattatctgggcaaactgtgactatcagtctccctgcattctgtgaagtaatttaatcctgtatcctcaactgttatccaaccattatcattttggatattttatttctagaggaagggtagggggaggattctagtaacccatgactaacagtgagtgagtgatttattctagctttgaacaggtcaagaaatccttttaaaaaaatgctaatatgatgatgaagggaaaagttggacctcttatacactttgtctcttgttaaataggaatctcattcttctcaactcatataacaggagaaatgttagattttcatttctaaaggatatttttcatggctaactctatacctttggcatcactcagcagagattattcagtgccttctatttgccaggcagaccctgagccagaacttagattttagtggaatgaggctgagtgttccataatcagtttggtgatcccttgacattgagtaaatcataaatsacttagtacccatgtgtgtaaagtgtgtaaaagctttgagtggatgcagtaacaagcattttacacacatacttgtattttatctgaggtacatgcttactgtcttttcctcaggaatgcaaacttcatcaggacagggactgtgtgtgactgttttgtttagtatctaaagtgatacagtaggtaatcagtacatatttattgaatgaatgaacactggggcctggtctgttttaattactgctctgtggcaaagcatccagtatggtgtcttgtacaaagtaagtaaccagctacaacagcaataatattaactgatgcattgagggcttcactctgtctcaggcacagatttaatcctcatggcctttctactacctgtgtgctgctgttctccccattttatagatggaagagttaggttttttaactaggaaatgacagagctgggagaatccttttgacttcagagcctacactgttaatgttttattgagttttcttccttacatgagtattgattgactctcctgaggagttcaaatcttattatgatatagtcttggttacaacatctgagagatgtctgaatagccttatgaaccaggttcatcagaatttgcaaagttgtgtgtgttactgttgatgtgacgttttatttcatgacagcacttaatcaaacttgtaacacttaaacttacagcacttatatcactcacattcactacattcattcattcttttattatttcgacaaatactaatatctactatgtgttagtcattgggctaactactggagtaccgcagtgagcaagacggacaagacccagcttttatagagcttacaattcagttgagggagacaaacatccaacatataattgtgacaggggtccatagacttaagcatagggagtaatgacatctatatatggattgggaatggtcacataattctttcctaaggaattatgttgatagctaaaaaggttgagagtaactctcgttacaggttggaccttttactgtaattcttttttttatttagactgtaagaartagggctatgtcatttatatatacacacacacagacacagcatgtgcagacacacccctccaagagcctaaagtagtgtttgtaatgtgaaatgcctgctgttagtgtttatttctagrtagatggaacagatcgtacataggtagaccagcataattctatgcatgtaggctaagagtagtaattcaccgttactgaagcttaaactgcatggtattggtgagtaaacagaacgtggtaggagatraggctggagaaatagttactgaaggaatttggatgctgtacttaggaacatgggctttatctaacaagacactggagaaccaacagagcgtaacaacagagagaataacatctgagttgggttttagctttgcggtagcactgggtaggctaaaatggaggatgtgaatgaggctagaggctgctggactgaagtttggaggtggatctgagaaggggagtgacactgagttgctagtatgcacctagcacctccttaggatcttaacatgcgtactctctgatcctcacaaccctaggctgcaggtgtcatccttactattacccccatgttgtatcaaagcccagagagattgagtaatttgcccaagaacttaacggggttagagtttggaacccaggtctgttttacttcagatcatttcttattttactatatttcttctttagggaccaggaggttatgactagaaagtagagtattgatttcagaggctgaacagttttgggtgataacaagtatagagtgttaactatgggaggaggttactgaaaaagactggatattaaggccattgacaatgtaaaaacaacttcccttacccctcaacaaaatgtcaacaaataaaccttatcaagtagttcttacattcagtaaatttggtaattaatgattattgccttatgacatctcttttcctgttcgttttttctttttaaaaatctggttttgtttttgtttgtttttttttttgagacaaagtctcgctcttgtcccctaggcwggagtgcagtggcgtgatcttggctcactgcaactccacctcccgggttcaagtgattctcctgcctcagcctcccgagtagctgggattacaggtgcctgccaccagcccggctaatttttgtatttttagtagagatggggtttcaccatgttggccatgctggtctcgaactcctgacctcaggggatccacccacctcggcctcccaaagtgttggaattacaggcatgagccaccgcgcctggccaaaaatctgattttacctttattttgacatgtgcctcttttttctcactgtgttttaaggttattgaaggtactgatgagtcataaatatttgatttcattctgtaaagcatattcttgtcattttagttgaagttcttgattgtcctggagattatgggatcatctgagtgttttggaaggcaatagaacataatggtatataggagcacacatttcagaatctagaggaccttgtttgaatcctggctagattacttactagttgtgtagccttatgcaaattatttagttgttttcaaccttttcttcctctgttaatggtagtattaaactatgtcatagaaatgtaatgaggcttacataagacagtacacgtgactggctcactaactggcacattttaagctacccaagtggtaggtattattgtagactgactttttttttttttttttttttgaaacttggtctcactctatcatgcaagctggggtgcaatggtgcgatcttggttcactgcaacttccacctcccgggttcaggagattctcatgcctcagcctcctgagtagctgggactacaggcacgcaccactatgcccagctaatttttgtatttttagtagagatagggtttcaccatgttggcctggctggtcttgaactcctgacctcaagtgatccacccgcattggcctcccaaagtgctgggattacacagactgacttcttgagatacatcttgtaattatattgatgattacaattgatttgtaacacaatacctttatttcagtggtagcctggataaccaggtgccttattttccttataatgatctaatatgtaacacttgtaggaatttgtagagtacttttcttgacttttttctttgagttaattttaataacattaattgcsttgtttaagtcagtcacctcttattgtactccagtatttttaaagtatcaacctgatactttaaacctggtaggagcacacatttcagaatctaaaggaccttgtttgaatcacttcactgaaacacagattgctattcacctgtcatttgccacttttccatcaggtttgccttaaataaatgtatttcatttaactacttttctgtatccttttttttttttttttttttttgagacagagtttagctcttgttgcccaggctggagtagttcagtgacacgatttcagttcactgcgacgtccccctcctgggttcaagcgattctcctgcctcagcctcccgagtagctggggttacaggtgcttgccaccacgcctggcaatattttgtatttttagtagagacagggtttcaccatgttagtcaggctggtctcaaactcctgacctcaggtgatccacctgcctcggcctcccaaagtgctggaattacaggtgggagccaccacacctggcctgtatcctgattttttaactttttttttgagacagagtcttgcactgtcgcccaggctggagtgcagtggcgtgatctcggctcactgcaagctctgcctcctgggttcacgccattctcctgcctcagcctccccagcagctgggactacaggtgcctgccaccacgcccggctaattttttttgtatttttagtagagacggggtttggtcttgatctcctgacctcgtgatccgcctgcctcggcctcccaaagtgctgaggattacaggtgtgagccaccacacccggccctgattttttaactttatgtatgggactcaacctgtgaaattattcttgacaaggagagggtgagtcagaatcatgtgttatcagctttcatttatatgcatcctttggtacaggtgagaggtagatgatttgtttttctgacattttattatgaaaaattataagcatttagaaaattataagaattttacattgaacacccatagttttcttccattaacattttctgtgcttacagtaccacatatgtgctcattcgtttatccatcagtgcagacgtgtgtatacttcccctaaatactggtttgtttttgaaagtttgttcctggcttataccctcctgtattctcagttgacagatctttacataaagagtctgcttttttctcatttttgtgcatcttagcactttagtggtattgtaatggaatattacatctagtatgtacagtgagagaggagctcttgaatttttggtattttctgaagtttaaaaaaaaacacctaagattacatagtgaatagggaagtaaaacccaaggtttttggctattatcttttatctcttgtttacttctcctgaccttactaaaacaagttcttttccaaaccaaatttatttatcattttagtaccatggacctactataagaattgttacatatcagtgattaaaagtatatgctcaaaaatacatatacttaaaatctaaaatatttaattcagttttattgtcattaaaagggtttttggrgaattatagcagtaatatatgttataaatatatatgctcatgtaagagtgagaaaagaatataaaatatggcaaaaattgaattttataaaaactttcctagaagaaggattgggaggacctataaacagttctctctgggctgtatggcaatgtggatgggttgttttytttttaattttgctttagtgtatttaaatttattcagtaaacctaaatttttaatcagaaaagacattaaaaattcagcaaagaaacctgttttgtagcttgtatttacattactctgaaattaaaaattagaacccatttaagggatgttgtgtagatcrtcatttggttcaagatttgaaaataaaaatacattttattagatacttaattctgaaccgaaatcagtgaaccaagcagggtggctaaaaagcacagatggatcagtaaaaattgaagcaatttttcatgtattgaaatgactatacatattttttcatgtattatctcaattatcatctgctataaccaaagagaatctagtattttcatttattcaacaggagggattcttagattttgtggataattgggctgagtaacttagttatccaccaacacagaggttctgtgattctgttcaggccagcaaaggttttttgaatgatcctactctagggatgtgtgtttttggggagagggggtgatgcaaattaaaatagtcttctttgtaggtcagaatatagctactatgtatagaatacttattatgtatgctataggtactatgctaaattatttacatacattattttattctgttatcaccctatgaagtaggttttttttgtggtctttcttttgccaggtatggaaacaaagatgaagcaggttaaattactcacctaaggtcacataggtagtgattataaagcttgattattgctctctggaattttagtttatgatggttaaaactgaggaatggaatagtattgaataatggaaagaccaccggaagtagagtcaaaaagcttagtttgtctctgcaactcacttgctggttaaccttagacaagttaattgacctctctgaacttcttgtttattctgtgaaatgtcttatttatgacatctttatcttcctcataggaaattctgagactcaaacatgataatatatgtgaatatgtgttatgaattgctaaatgctagactagttggggttgtcaggacagtggaaggggaagaaaagggagactgtttcctaactcttaacagtcactgttactttatttgaagttggattgagaagaatgggagtaattggacttacttgcacatttgtattacaattgttaaactcctaaggatactgatcaaaattaattttcaattttttatctttatttgaaaaatggccacaatagttaattgaatattctggttagcctattatcttaaggtatgtaaaaattatcaatatgcaagtwcaaaacatatttgttaaatattacatagaagctgttttttccctcatatttcagaagttaaggacctgaaaaaggtaataggtcttaaatttattggaaatactaaagcattatataaaattatcttatttaattctaacatcaatcattgaaggcagtgttttcatccccatattacagaaaggttaagtcattgggtcaagttcatacaactactcattggccgtgctgagatatgaagcccagaatgtcagattccaaagctcaggctctttgcttcatacatacttgtcttccagtatcactaaattccgtcagttattaaatcaatagaatttaggaaggtcagtgaatacaatgtgagtgttacagaactcagttgtgtttctgtatgttgtaatgaatagaaaataatagaaaatgaaatttgagtatttatgccatttttcagtagcatcaaagagcatcaagtagtagtaataaaatagtgcagaaactatgtagaaaatgctgatttgtactgtaagaggtttaagtatcgggttatttgtttgctcttccaaagagctctttttggtaaatattaagcaatttactattttatatcaatttgcttttatcgtagttgatgctgatgtaacagttataggttctggtcctggaggatatgttgctgctattaaagctgcccagttaggcttcaaggtaaggtttgaactcaaactaagtattgatttattttaatttgggaagggttgatcatatttataaagtactttgcaggcaaaaacatggtaaatacttccttaactctataaattacttgtaagcctgagactaataaagattaggttcatttggttgtagtattctcttggaatggaaagtgaaatctattagttttcttctcttcccagtacttttcattttggcatctaatcacactttggaagatacagtgatagaactaaaagcatatatttggtaatgttaagcacacaaaaatatcttttagaataattcacttttgggtcagcccaaaagtgtttattattattcaaatgataaattataaaggactatatattttagtctgtgaaaacayagcccgaatagcttgttttgtagaagaattaagacatatatttggaattttagtgatctgaaacattgaggttatgtgcagttaaataatgttttctttggttgtagacagtctgcattgagraaaatgaaacacttggtggaacatgcttgaatgttggttgtattccttctaaggtgagcatgtgttttgtacagcacagagattgtttttggctagcaaccaactagaaggatggattgagactagattagacaaatacacttgttaaaaaacaatccaagttgtggcacatttcacacagagaaaaaaaagaatgataaaaaacacacttctcttttgtaaaacttaaagagtgctgtcactagtctgccacacattcctgaaataacttccttgtctcagaatgcctagctttccattcaaacagactctgatgttctagttttttctctttatctttccttcaccagtgtaacagataatagatagtaaattgttcttttaggtcctttttgtatgtaaacatgactgcctttttcacctgccaccctgaagtgtgtacttatgcctttacttttaaagaaagtaaaaatgtctttttcattcttgtttgttgaatgtttttcacatcattattgtttgtctttgattaataagagaaactgaattggtgtagtgccatatactrttccatgtagagaatgccatgtcttttttttaacttctttttaaatttttattgtaaattgacaaattacaattgtatatatttatggcatacaaagtggtgttatgatttatgactataatgtggaataatttagtcaagttaattaacatattcattaccacagtacttatcatttttgtgatgagaacatttgaaagagaatatcggccgggcgcggtggctcacgtctgtaatcccagcactttgggaggccgaggcgggtggatcacctgaggctgggagtttgggaccagcctgaccaacatggagaaaccccatctctactaaaaatacaaaattagccaggcgtggtgatgcatgcctgtaatcccagggacaattgcttgagcccgggaggcggaggttgcggtgagctgagatggcgccattgcactccagcttgggcaataagaacgaaactccgtctcaaaaaatgaaaagaaagactatcatttcataagtgctttttgattatttgaagtctgtttatgaatatttgataatttgatctttttaatttcctttaggctttattgaacaactctcattattaccatatggcccatggaaaagattttgcatctagaggaattgaaagtaagtatacttttcatgcttaatgatattaccagactgcttgacttggctcttctgtctaaagacttaaatgtgtctaacgtacgcataatagatgtttagtgraggaagagtaaaataaataatctaaaaaatgtggagagatttacttaaaaaagaaggcctaaatccagatttctcccagccaagtataaccaagcctaaccctgcaaatcsagatttctaccattatatcttctgttcctttgccaactttttcctgaggtttgcctttatgtgtttttgaagagtcagttttcatttcctaaaatctggaaatcactgrgaaggctggattcctgagtactatggggagatagaggaaggaaggaaggcccacttaagctgttgatagtagaaaaattagaggagagaaagagtgaggcatagcggaaaaggaagaggacatttcataacgtatcttgtctcctgacatactttttgagctgttttaatcttttgtctccaattattgttgttgttagatacttccagaaaggtagtctcttctgggcaggacctagtcataaccttgggttgttacttttccttcatttgtttctttacagaggtaggtttgaggggctacttaaggcaatccattgggtatagagatgatgtatatgcactaaagcaaatagaatatcatactagttgaaaaatggaatgacgtaaagaaagaagagctaggggtagtcaggagacctgcaytgtaggcaaggcttttacatcctagctctgtgaccttgggtaaatcagaaatctctcagagtctctttttccttatctctaatatatgtgttggttatatgaggtactttctaagatacccttcttacctctaaagtttaattgagttgagcatttttatctaatactgttgcttcagagttctcttctgagttgaatgagtgattaaaacctaggtgattaaactttttaatgttaagcttctgtatttgaaatttttaaacgtgtattttttatttgttttgtttcatgaaatctagcattttcctttatttaaaatttcagatgatgttttactttgtcatttctacttacatatcttccagacttataaccatcgtaaagtgttcagaggatatgttatcacagtgggatataatgttttattttggactgcctttttacccaaggtagacattttatagtgtttgataggttctgtttctgtgatacaatgatgttggccttttgtcaactataattataagttattacattttgaaactttaatactgccttttataagcattaggttgaaattttccagttggtgagtgaaaaacactgcatattgcttcaagaatttagctaagaactaaagattaattgaacaaattacagtgtccgaagttygcttgaatttagacaagatgatggagcagaagagtactgcagtaaaagctttaacaggtggaattgcccacttattcaaacagaataaggtcagtgtttaatattcagatttctgctttactttgaatacaaattaaactttgcattatagagtgatgatatttgaacttgrttacaggggaatatttatttaatttaaaatagcttgctaacctgaaatagatttccctgacatatatcacagatttttttgctgcaccatggtgtagcattactaagtaaggaagcattttgttttagataaattatttacagagtaatttttcctttgaatgatttatcaaacaaattactttaaactttgtgaatttataaagattatttygtaaaggttgttcatgtcaatggatatggaaagataactggcaaaaatcaagtcactgctacgaaagctgatggcggcactcaggttattgatacaaagaacattcttatwgccacgggttcagaagttactccttttcctggaatcacggtatttatgcttcataatttacaaccattacaacttttctttagaaatacgttttataagttatttatgctatttgtgaactttgagagatttctgactgaaatactatattttgatggtcattcagctttgggaagttacctgtctttattctgcagtgattctgaccagctatagaacactttatattaagatatgtttgaatacagtatgaagttaaaattgaccattgcgtttggaatattggtggataaaatttaaagtcagtgtttttaatgggatttgatgaaattaggtatatagatacctcaaaacaaataaatgacttagtatttttagtgattctactgagatcacagtttataaatacatttatctcttcatatccttggaggattggttccaggaccccccttggataccaaaacccacagatgctcaagtgccttacataaaatgacatagtatttgcatataatctgcatacttcctcctgtatactttaagtcatctctggattacttataatacctaatacactgtaaatgctatgcaagtagttcctatgctgtattgtttagggaataatgacaaaaaaaccatgtgtacatgttcagtacagatgcaaccatcaatttttttcctgaatattttcaattaatggttggttaaatctgcaaatttggaacccatggatatggagggtcgactgtactaggttttttcaaattattttgattatatcttttgtttttcttacagatagatgaagatacaatagtgtcatctacaggtgctttatctttaaaaaaagttccagaaaagatggttgttattggtgcaggagtaataggtgtagaattggtaagtgttgtctttctgcctcttattacctccttggagttggaagggacttaaaggtcccctttttgattttttgtataacattacaggctgatcagcattgagttttgcttaaacacttctagtaataaagagtttacttttgtttttttcaagacaacctatttatgtatttactcatttagaatgttctcctttattttagtctgtttccttgtaccttccacccttccatttcctagaactggtcgaattcttttttaatatgacagccattcagatatttgaggacagcttttatcctgggcaaattgcattccaaataaagattattctctttaccatcacatacatgatttggctcttcccttctctatcctcatcttgatgcctcttaacttaggttttagaaatgtcaaactacttgcatttctttgaacaccatgttattttagaccttctgtctgccttgttctcccttcttgtccatctggcagctttccacacatttccaatgacctccctccattttagagtcactgtgccttgtaaacaccaggaattgctctacttctgaaataataaattcagatattttattatgtaaccatgacctcctttcctcttttactcagttattcatagtgtactttgtacccttttttaggttttctagtccatagatctacttttttgcaatcttccctttccaatcttgactgcgttcctgatcagcttagatgccatagtccatcactttaaccacactcttacagatrtccttgagttgcttgtctcactgttctgtcatatctgcttggcaaaactctagttcggtttgaatgcagcagtctgccttttttatgctatttccaggctgttgactacacctggagaaaaacacaccctactcattggtacttgtattaattcttggcacaaaccttaacaagaacctcagccttgctgacagtttattatttcctaagatggtacactgccctggtctctgcaatggccattttcattttctactcttctcaaatctctgcttgtatactgtctgctctgcctgtggatgaccttgtcttttaaatattacataaaagagaaatcagatgagaactccctcaagttgatgtcctaaatttgataatgcttttacctgttgttacacctatccttttgattacctctcctattactgtggaaatgccattttccctaagactaatccctttacttgtgcttggtagcacatcatctgccttttcagagacttggttttgtgatttttattcttgtatttttcagtcttcaaactccttccttttatttacaatttcatgtgcttctatgtgtgtacctgtgatgcatttgcactcattaacacaggtttgtgtgcacataaatgctccttatcttggtcccatgtccttcttgagttaccaattttgttcgcacttttccttcaaaacccagcttctcaaaagagttgtccatgctttatttcatcaacttccactcactcagtctatggcttgtgccaataaattgctcttagggcatgaatctatttattgctcaatctgttggactaatttcttcactgctttatttggcagtaattagcattgctgattttcttgcctttgaaacactttgcctaacttctgtgatttcatattcttccatttttacatctgctctttgggctgaattctccatattatgcaagttcccctttcttaggcttccctttaattgttagtatttttgtttttctttttttttttttttgagtccgagtcttgctgtgtcgcccaggctggagtgcagtggcgcgatctcggctcactgcaacttctgcctcccgggttcaagtgattctcctgcctcagcctcccaagtagctgagactacaggcgcccgccagcacgcccggctaatttttgtatttttagtagagacggggtttcaccatattggtcaggctggtctcgaactcctgaccttgtgatgcgcatgatggttcatgtctataatcccagcactttgggaggctgaggcaggcagattgcttaagcccaagagtttgagactagcctgggcaacaatgtgagaacttatctctaaaaaaatgtaaaaaattagttgggcatggtggtgtgtgcctgtagtcccagctactcaggaggttgagatgggagaatcacctgagcctgggagtttgaggctgtagtgagctgggtcatgccagtgcactccatcctgggcaaaagagtgagaccctgtctcaaaaaaaaaaaaaaaccccaaaacaaaaatcagcttttaagttatctttttagtgaataattctttcttctaagaaagctcaagtctttcattttttgagtccttagtataatatatctacatttccatagtacccactaataataatacattgcatttgtttgtctatggctgactttcctataagaccaaagctccttgaaggcaggaccgaatttttaattcctatttgaatctccattgtttttcttaatgtttagtacttaggtctcctagacagcaggtctgttattttgtcatcaacctttggatcctgtctagtccgttaagaaaacttgtaatctaaacataatgttctgggttgtagagagtacttcttttgatatgcatagtatacttcttgtaatgtaatgctttgaaatcagtttagttgtttttataaagcagacattgagcttatgttcagataaaaaccacatttttttcgcatttggaattctgattttttaaacctaagtgactttgaacctttattcttgctttaatttaatcttgttcactcatactcattattccaatctatatcttagtcttgattctgtcactcttatacttaactgcttttacttttcatagttcgtaaattttggaagtatgacaattaaggcatgcagtcccatcatctgatctgatcttggttaagcaaacttctgttgtcattcacgtcattagtacaaatttttgaccaggatgaaacatcgaaagccatctgacagtacagtctttcaccagttataaacacctttgatgtttattcatcttcgtttctccatckcatctacaaggatatcatgagattttcttaaaattttttttaacaccttgctgatatcaaaatatactacattcaccagtccagaaacccttcagaaagtaagagtggtttatgtgacctgtttggaacacttgtggtagtgtctactgattgtgaaaccagctgattaataatgtcttctagtatttagcagaatctcttcttttccatttttgaaaatttaggcatatttgcctgtctgccaccttttggcagttcccttgtgctaagtaagttcccagagttcactgagagtgcctgttttgtcatactctaattgggttgatgggagaattaactttttttttttttttttttttttttgagatggagtctcgctctgtagccccggctggaatacagtggcatgatctcggctcactgcagcctccacctcccaggtcccagttcaagcaattctcctgcctcagcctcctgagtagctgggattacaggcacgcaccaccatacccagataatttttctttgtatttttagtagggacggggtttcaccatgttggccaggctggtcttgaactcctgacctcatgatccgtctgcctcggcctcccaaagtgctgggattacaggcatgagccaccacacccagccgggaattaactctttaaaaatgaccagttgttcttaatcttgggcgttgcctcttggttaataatatttcttctgttcattctactttgttctcatagttggataaaacaagaaaaaaggaataacatttactttcttttgttggtcattataatatctcgaagcaataattctatttcttcatctcagcagttttgctttaggttttttataagccttgagtcttttgacacaatgatttagatacctgttactgtattgaattagtttttacatgtctttttaaaaacttattagagaatttactgtgtagtcatgatatctatttattttcttgtaaagattattcacataactgtattttcattttttatattttgcctttcttccattccagtttagtgtagtattaaaaaacatcttttttggaattgaacagatttaaatttgaatttcaactctgcctcttactgacttatgttcttgttaatgagccactctgaaccagttggtttgtcatcaaaaaggggataaaaataactaacttacaggagtattgctgggatttaatacatttaaaacacttaatgcagtgcctggcatttagtaagctctaagtaagtggtagatgctattgagttttcctatctataagtattttgaaatcagttttcctaaagagtagggcacttgtctatgctcatcactccctactttgaattagactccaagatgatgtttcttatttccacactcccattatttcccctctatttacttctatcccagtttccaagaatggtcctttcttttgtcttgtttgctttttaaacagctttattgagatatagttcacatatcagttcacccatttaaaatgtacaattcaaaggtttttagtatattcatagagttgtagagctgttaccattgtctaactctagaacattttcatcaccctaaaagaaacttgctacccattagcagtcattctccatttctccctttgctcagcccctggaaaccactaattctactgtgtctatgaatttgcatattgtggacatttcatataaatgaaatcatacaatattattttgtgtgtgctctctttacatagcataatgttcttatggttcatccaagttgtagcatgtatstatacttcatttctttatctggctaaatatctcattctatggatatggcacattttgtttatccattcatcatgggtggacatttgggttgtttctactttcagactattatgaatgacactgctatgtctatttgtgtacaagtttttgtgtggttatctgttttcatttctcttgggtatataactggatgtgtaattgttgggtcatatggtaattattttaacttctcaaggaacaccgttacacttttccatacaatcccaccagcaacgtaaatttttgttgctctgcttttccactgacacttggtattgtcattttttttaaaaaattgagctattctagtggttgtgtagtagtaactcactgtggggtttttttttctatttttattttttaaattgctatgtaatagatgtacttttttcaaggtacatgtgawaatttgatatattcatataattaaatcagggtaattaggctatccatcacctcgaacattttttttaatgctaggaatattgaattattctcttctagctattttgaaatgtgtaattgattgttacctatagtcaaccctgcattaacaccagctcttatttattctgtctaattgtatatttgtactgatgaatcaacctctcttcattcctcttctccccctagccttcccagcctctggtaaccatcattttgctctctatctccatgagttcagtttgtttgtttttttttttagctcccacatgttagaacatgcgatatttgtcttcctgtgcttagcttattttgcttaacatgctgtcttccagttccatctgttctgttgcaaatgacagaatttcattcttttttatggctgaataatattccattgtgtatatgtaccacattttctttgtttgtctgctgatggacacttgagttaattctgtgtcttggctattgtgaatagtgctgcagtaaacataaagcgcagatacctcttcaatatattgatttcctttcttttggatatatacccagtagtggaattgctggctcatattgtagttttatttttagttttttgaggaaccttcatactgttttccacagtggctgtactaacttacattcccactaacagtgtatgagggttctcctttctccacatccttgtcagcatttgttattgcgatctttttgataaaagccattttaactggggtgagatgatagctcattgtgattttgacttgcatttctctggtgattaataatgttgaacattttttcatacatgtattggctatttgaatgttttcttttgagaaatgtctattcggatctggtgctcattttaaaattgaatttttttgagctccttatgtattctgattattaatcctttgtcggatagtttgcaaatattttcttcctttctgtgggttgtctctttgtggactgtttccttggctgtgcaaaagttttttaacttaatgtaatcccatttgtctgtttttgctttagttgcctatgcttttgaggtcttacacagtaagtctttgcccagaccagtgtcctggagcatttctccaatgttttcttacagtaatttcatagtttcagattttagatttaagtctttaatccattttgatttgacttttgtatatggtaagagataggggtctagtttcattcttccgcatacggttatccagttttcccagcaccatttatcgatgagactgccttttcctcactgtgtttgtggtacctttgttgaaaatgagttagccgaaaatgtgtggatttatatttgggttttttattttgttccattggtctgtgtgtctttttatgccagtactatgctattttggttactatagctttttagtaaattttgaagccggttaatatgatgtttccagctttcttctttttattcaggattactttggcagttgaatatcattggtagtttagtagggattgcattgaatctgtaaattaccttgggtagtattgtcattttaacgatattaatttttccagtccatgaacatgaactattttttgtgtcctcttcaatttgtttcatcagtgttttttagttttttattgtatagatctttcacatctttggctaaattgattcttaggtattttatattcattatagctattgcaaatgggattgctttttttttttcttttttagattgtccactgttggtgtatataaatgctactgatttttgtatgttgattttgtatcctgcaactttactgaattagtttgtaagtttaatagttttttggtggagtctttaggtttttctaaatataagatcatgtagtctgcacaaaagattaatttgacttcttccttttcaattcgaatgccctttgtttctttctcctctacaattgctgaggccaggacttccagtactatgttgaataaaagtggtgaaaaatgggcattcttgtattgttccagatattagaggaaaggctttcaattttttcccattcagtatgatgttggccatgagtttgtcttattattttgaggtgtgtccctcctatatccagttttttgagggtttttatcatgaagggatattgaatttttattaaaggctttttcagcatctgttgaagtgatcatatggtttttgttcttggttctgttaatgtgatgaatcatgtttattgatttacatatgttgaatcatccttgcatctctgggatgaatcctgcttgatcatggtgaatgatctttttatgtgttgttgaattcaattcattgtggttttaacttagatttctctaatgacttacggggttgagcattttttaatgtacttacgtgccatctctatatcttccctcttcagacatttgtccattttttattgaatttttcttattgaatttggagaattctttatatattctggatataaatcccttatcagatagaagttttgtaatttttttccccagtctgtggcttctgtttttgtgttctcaatgttatctaagactttctaattttgacaaagtccaatttatcatttttcttttatggattgtgctgttggtgttacatcaaagaaatcttcgcctaactcaaggtcacttctaggatttcttctcctaggtgttcttctggaagtttcatagtattggattttacatttaggtccatgatccattttgagttaacttttatatatacgtattgttagatttttagtgtcactatattgcctctagttaactcagtcttcatactagaaattaatgagattttttaaatgaacgcccacacctaatttagggaaggtaaacttttatagttcatttgaattaccagatgattttaatatacattcttgcaaaggatatgttcatggtttttcatatttaatgctgtgaaattatgttcatcttgccagttatgtattgtttaatatataattatttagaagttatactaattgtcaaaatgttaaaataaactagcattcagtttaaattataatttgaatgaaaaagtaaacatttgtcctttgttgagaaaagaaaataggaagccagtttaatattctgcaaacatcagtgatttagtaacctgtttccttttcctcaagacttttgtacttgctgtttccctctgcctagagcaacactcttgccccagttaactgggtagttcattgcctcactccttcaagttttgtgcaaatgtcactcccagtgaggctttccccaaacgtgctatttaaaattgtaatcccagtaatcagtggtcctagttctacttcctgttttatttttcctgtagcactttattctctgttatgaattttacatatttgtctatgtcccctgccagaatataagatccctgagaacagagatttttgctttgtttactaatgtatgcctagaagctaaaatattgcctaccatgtagtagatgttcaacaaatgttgaatgagtaagttaataaatgtatgaagttatacatatttaacacagggtcaattttaaacctcggagcttctcataggaacatactagcgaaagaagaaaatgttttacaataaattattaagatgatttcgtaaacatttgctatagaaacttttatgattattgggttttttwaatttatttgcagggttcagtttggcaaagacttggtgcagatgtgacagcagttgaatttttaggtcatgtaggtggagttggaattgatatggagatatctaaraactttcaacgcatccttcaaaaacaggggtttaaatttaaattgaatacaaaggttactggtgctaccaagaagtcagatggaaaaattgatgtttcgtaagtatacatcatttgtttttgatgtatcatccctgtctctttaagcaaaacactcaagtttcaaaatcagtttagcaaatatagggttttttctaacttaaggtcattttattacttaatrtaactcagttgcttatcaaattattgcattagcacattgaaatttatgattaggttaatgctagaaagagaatccaatattctcattgttgtgccttcttatagtacattcagaaaaatttaaattcccaataataagtaaaattgaatcaatatttttaggcagatacatggggaaatcaataataaaagattgcttactatatgtctggtactctactgattaaatactttaatggcatttaacttattgaattagtttttaaataaatatttaaattaaatagttaatagtatttaaatagtttaatgacttttactcaaagataagaagctgaattcattgactaattaatgactaacttgtcacacagctagtgggtggcagtcagtagttgaatttggatttctgtgactcaaagacctgtattcttaactgctgttttattatactgtggtttttgtgagattttaataacagacctctagattttaatgatagatctctttcattgtctgactcttatgtttatattcaaataaacttatattgttaaaaatgtcatcagtgccggctgggcatggtggctcacacctgtaatcccagcattttgggaggctgagatgggcagatcatgaagtcaagagatcaagaccagcctggcaacatggtgaaaccccgtctctactaaaaatacaaaaattagctgggcgtggtggcgcgtgcctgtagtcccagctactagggaggctgaggcaggagaatctctggaacctgggaggtggaggttgcagtgagccgagattgcaccactgtactccagtctggcgacagagcaagactctgtctcaaaaacaaaacaaaacaaaaatgaaaatgtcatcaacacttgagaaattgctggccttaaatttctaagcctatcaatttatgtaggtgtgtatttaacatttatacactgtttgttatctagtattgaagctgcttctggtggtaaagctgaagttatcacttgtgatgtactcttggtttgcattggccgacgaccctttactaagaatttgggactagaagagctgggaattgaastagatccyagaggtagaattccagtcaataccagatttcaaactaaaattccaaagtaagttggataattgtctgcattttcagtaattttaaaattgatttcaaacagtattttgaaaagtaagatttttatgcttaaaatatgtattggctttggggaagaatagtaaacttacaaaatgtaaaataaaaaataactgaattttactcaaagataagctgaattcatagatttttgaagagctgcatttgatgtattttttggtgacttgtttactggaaacttttgttaccataatgtaactgaaggtaagtagctgtgatttcagaaattcattgtgtttcttttgatttctgtggtagtatctatgccattggtgatgtagttgctggtccaatgctggctcacaaagcagaggatgaaggcattatctgtgttraaggaatggctggtggtgctgtgcacattgactacaattgtgtgccatcagtgatttacacacaccctgaagttgcttgggttggcaaatcagaagagcagttgaaagaagaggtaagtctgaacrtgggtggttttaagccaatgtgtgagttgtgccaatgacattggtggttgagaaacagcattttatcattatgctaatatatttaacagctgtgaaatattgtttagcttatatatttttcccttgttagcattataaagagatcattcacagatttatcagcagtaattgagaggaagagaagttgcctatattaaaaaactagtaattccagatcttttatatttggctttgaaatataaccagatggacagacatttgtatttgcttgtattcgtgcctgagatatagttcattaaccagtcttctggtctttcctttccttctatgtgctttgcgaacaattcccttcttgggatttattttctgaacaaatggtagatgattttacaaattggaaagaacttttctggcagttacgtagattctttttttctgactgtcacagggtattgagtacaaagttgggaaattcccatttgctgctaacagcagagctaagacaaatgctgacacagatggcatggtgaagatccttgggcagaaatcgacagacagagtaytgggagcacatattcttggaccagtgagtattgtaaaaccagagaaatcccattaagatttctagaaagcattgctgtttattaattataaaccacctggtgttagtctgaggttgctcatttccagcaaaactttgaatatggctctctgtgcatcatttctagaaggataccagcagcactctcacagtcttgcccactgtatcatctactttgtcctgcagccaagattctctctttaaaacatacaccagattatgccccttaaaatcctccagtggtgcttttcaacttcagattgttacatccaaggcctcactgaatctgtttgtgcctacttctctgacctcttctttttctgctctcttttactcattaatgccatgtcacatgggccttctctcattttcacaacagaccaaatatttgcattttagggcctttgtgcttaagataccctctgcttagactgttctgcctccagatctttgaatggctggctccttattattcaggtctcagctcaaatgttacctcctaagggaagcctttcctaccactgagcctaaagtatgtatctttcttgtagatatctcttgtatctgatgtaacaataatgagaatagaatatttgagtgctgtgtcactttagtrtacattttgttatttttacatcagctttttgaaataggtgctgttatttttgaggtgaagaaactgaatgaagcacaaagaaccaatgaatggttaaggtagtaagtggtagatatgaattgaaggccctttggctccagagcccaagctcttctgtgtcaccttttctattaagcttttcctgacttttcttcaactgataaagaaacagatttaaggcgtttttaagatctaaaagcttcccctcaacaattgctatcctattagcatgtagtttttgccttggaagcaaatttacttggcttgttattttaaagggtgctggagaaatggtaaatgaagctgctcttgctttggaatatggmgcatcctgtgaagatatagctagagtctgtcatgcacatcyggtaattattaacaacatatagaattgatggttgcctaaattttcttctgacccacaaatatttggattttaattttaaatttcttcccttgcagaccttatcagaagcttttrgagaagcaamtcttgctgcgtcatttggcaaatcaatcaacttttgaattagaagattatatatdtttttttctkaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatrtgtaagacaaaaarrtacttattgtagcatcmtggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgyaagtaaayggtctctcacttgttttatttaaccyctaaattctttcattttagkggtagcatttgtgttgaagaggttttaaagcttccattgttgtctgcaactctgaagggtaattatatagttacccaaattaagagagtctatttacggaactcaaatacgtgggcattcaaatgtattacagtggggaatgaagatactgaaataaacgtcttaaatattcatttactggttatcatgagtacgtgttgagatggtcatagttttttttatgactacttctagtgtatattctaatttcttttctaggcctgaatktatctttattttcatgttataggacaatattaaggcattttaaaggtcatcatcctttcatctattttagatacacctactaaatgtttaatatatacttttggagaagtacaacataagggagtctttaatctgtgttttccttgkctgggttaatgactgtttatttaaagagtgytgtaaaattggatgtgtggtgtttaaaatggccatgtcctgaggaaacttaagtaacaaagtactaaatgctaagtaggcttttgcatattgtaactaaatttaagaataattcagattaagtagttctgaaatttggtatagatagcatagattgtctcatgctcatgagtgacataatgaccctggattctgttacatacttctaaagaaaattgattgttgtcttaggaggcagttaacttggctgaacaccaactccacactctgtcttgtttgtaggtggcagcagctgaaatctcttctcagttgttttagctttagctatgctgctggaagtctttcccatgcaagtgtgtagttcaggggtcaaccagagtttgggcagaaggaagtctgccccttctgtgcctcctgttttttgggggtttcccctttatgttccagctgttgtggttgccccatattctgccytctgatccttaaccaataaaacttggcttttgtttccccctcaagtgagaacccgttaaaaatgagacattgagccagtgctgttcactttttaagtgccaacttccctctactttccacttgtttatagttgtttccagtgcctttagttttttctaaaatatatttgttcagagtttgcagttgctatcagcaggagggttggtctgatatctgtgtgctactttgccattattrgaagtgaactctgcatctttttaaaaatttgaaatcccggtatcatgtgaagtgctgtttatgtaaatctcaacatatcccttactcagggaaaaaaaagtttttagttagggaatagtgaaatataatttaatatggaattctagctgtagagttaaatccatctttaagtgtttacattcagtatgagaatgcaaatttatctgtatggggaataaagtcctaggaataaaacaagttttaagtgttcacttactgttatctactaagctgtcaatatttttgtggcttgtgaagagtgaaattaattgtccacttcattgaactgattaaaattagtaatttcaactggctgggagcggtggctcactcctgtaatcccagcactttgggaggccggggcgggcagatcacctgcggtcaggagtttgagaccaacctgaccaatgtggtaaaaccccatctctactaaaaatataaaaattagccaggtgtggtggcaggcccctgtaatcccaactactcaggaggctgaggcagaatcacttgaacccaggaggcggtgagctgagatcatgccactgcattctagcctggcgacagagcgaaactccgtctcaaaaaaaaaaaaaaagtaatttcaaagtgagatctttagttgtttagctgaaaaggaatggagagtgtttctactgttctaagtaaaatactacataattgctctagtagatgatggggtatgaccatttttgctagttattgggatttttttttttaattaagttctggggtacatgtgcagaacatgcaggtttgttacataggtatacatgtgccatggtggtttgctgcacccatcaacccatcatctacattaggtatttctcttaatgctatccctcccccacccccatccccttgtccatgtgttttcattgttcacctcccacttacaagtgagaacatgtggtgtttggttttctatttttgtgttagtttgctgagaacgatggtttccagcttcatccatgtccctgcaaaggatgtgaactcatcctttattatggctgcatagtattccatggtgtatatgtgccacattttctttatccattctgtcatagatgggcatttgggttggttccaagtctttgctattgtgaacagtgcctcaataaacatacatgtgcatgtgtctttatagtagaatgatttataatccttcgggtatatacccagtaatagcattgctgggtcaaatggtgtttctagttctagatccttgaggaattgccacactgtcttccacaatggttgaactaatttacactcccactaacagtgtaaaagtgttcctatttctccacagcctctccagcatctgttgtttgctgactttttaatgattgtcattctaactaactggcatgagatggtatctcattgtggttttgatttgcatttctctattgaacagtgatgatgagctttttttcatgtttgttggctgcatgcatgtcttcttttgagaagtgtctgttcatatccttcaccaactttttgatggggttgaagttctttgcaaaaattttctcccattctctaggttgcctgttcactctgatgatagtttcttttgctgtgcagaagctctttaattagatcccgtttgtcaattttggcttttgttgccattgcttttggtgtttcagtcatgaagtctttgcccatgcctatgtcctgaatggtaattgcctagggtttttatggttttaggtcttacgtttaagtcttcaatccatcttgagttaatgtttgtataaggtgtaaggaagggatccagtttcagctttctgcatatggctagccagttttcccaacaccatttattaaatagggaatcctttccctactgcttgtgtcaggtttgtcaaagatcagattgttgtagatgtgtggtgttatttctgagacctctgttctgttccattggtctatatatctgttttggtaacagtaccataaaagtgacaaattattgctttgggccagaggaaagttattaacttacagctgtttacataactgttgtccaggcccagcttcagatgcagctgtgttggatgtgtgggtggttgttaagcagtccacagaatagtcttgctctaagaatgtgtgaaaaaaacacataggggctagccttttatacagctagttaggcaataaagttgacatgggcctggcaattactttcgttagattagttgcaaaatcacataaaatacaatacaaaagctgagaaattagagcatcattctgtgctctgtagtataaaatacaatacaaaagctgagaaattagagcatcattccgtgctctgtagtagcattgctcaattggcaggagcagtatccataaactctggcctgatttaactgaaaccttcccctcagtaaccctagtccttttctaggtggtaatgactacaaaccctagtacatcctgctgattttctaaaatgttgctttttctcattcctagagcaaggaatacttacttacaggagttttgatggctggagcaactcagcaaccattgaaatagtgatggtagcatagactatatttgtcctccttaacctcaacctgggaatcccactgggaggtgattgggaggaggggagtcaagggtgtggagttttggaggatgtttacctgtcaaataaatataatagcttgtttatagacaacataaattagggtcttcatggacgcagtaaacttgtttataaatccacgtttacagtgaaaaaagggattcatcaacaatcagtgaaagtaacaagtacaccaaaatatatacaaaagcactgtactttatttaactccatacaaaatgtgattaaaaacattaaataggtgatgttttattttgaagagcattaagtcagtttttaaaatgtagttgttttaccttggtcacctcagccattttttattctcctctgttacaagcatgtgctatacacagcaactttctggcttatatcctttaggagtgaacggacttctccttccagtcttgctaattcttgagctttatcttctaagtatctttgattgtcttcatattttctttctaaatctgtggagatatatatatatataaagtctgagcaatttatactatgatgatctcaagacaaagtgaatatatttttcacttttaaataaactatggatgccttaaagtaatttaaaaaataagcctgtgtgaaaagacccacctttgagcagttgcagcttgctatttgcttgagctaaaagagtttttgcttcattttgtagcatttcggctttccttctggcatcagctgactcttcagtttttttggcaattaaattttctacttttttatacttttcatcaagttcaccatctaaagtctatagttccacatttagacagaaagaagtggtaatgttagtgtcagtaattacatttaagagcaatagtgtaatcatggcatgcattctggattaagggccaccaaggatattcactggtaagtaatttaaaattttatcttcaaacagtggaattgaatgcaaaattgacctgattttaaagaacatttcaaaaaattctggagttgcagcaaatccttagggctaagtcctcattctcctgattattacttttctatagaaaagttgtagcataattgtattgcaaattacatagagaagcgcagatttttcaaaagtagattagacattagagaagcccatattgaagaagtggaggctctttggatcttgactaaattaggatttgtgaagacttgcttataaggaaatcagaggaaaaagattaaacaaaagatacaggaaggaaaggtgagattgtagcatatgcaagaagtgagtgaggagaagagaaatggggtgtggggttggaatgcaaatgattctttttagaaactgttcaaatagccatttatggaaatttcatttcaagagattttgttcctttctcttgtgataaaatgtcattatgcaaaatgccctgaagcagagtacttgagaaatttgtgtcctcagtactgcaggaaaccacacaaaccaaaacagaaaagacagctgtctgatattgtggcagtgaacttttctcattgttttgttctctttcccaacctagagagaggtagggaaagttactcttacgtaatgcccgaaaagctacagtaacttccagaaaatttttgaatagtagggagttaaatactgaaattaggtcagtaaatgcaggtgcccccaggcctacggaccagttaggaactgggtgggcaggcaagtattattgcctgagctccaccttctgtcagatcagtggtgacattagattctcataggagcacgaatcctattgggaactgtgcatgcaagggatctaggttgtgcactccttatggaatctaatgcctgatctgagctggaacagtttcatcctgaaaccatccccacccccgagtctggaaaaattgtcttccaggaaactggtccttggtgccaaaaaagttggggaccagtgattcaatggttttaagccccaccccggcgccaccaagtttttaatgttctctttagaaataagcattattgagaaactgaacatgtgtttcagttattacatggcttctgattaaacatttgggttgtgtgagtttttctctgcaaaatatagtgccttcgaatgagaggtgaggggtagttaattcaaaatgagtctcaaagagataagatttggtttcctactacctgttctctgttccaacctgcttgtaaaatattctcaaatggcctgataattactatatgccatgaagaatttaactgactaccgcacagaaataaaagttcaatatgactggtttttgtcaatatagttggtttaaaaaaaaaaaaaaagcctgttttgagacttctacccctaagttaattccgttcttctaaactcttgtccaaatttggatttgaggacataggtcatacttattagatatttccatattctttcccatccacacttctaaagacggctgttgcaaaacaggtcatttgatatttctgatgaattctgtttctgttaggtccatgtcccttactctaaggcaggcaaggaggagactggtggctcctttaacaacatagctctgaaattacaaagatttacgtaccttcttaacatcttctgcactttgcttcacagtatatactactttttcaatatattctgcctccccggagttttgggcagctttccgcttaagttcttccacattcctctctaactcgctgatgcgctgggacgcgttgaacaaggtttcctcagaagctgctgtttcagactcaatctaaaagcatgtcaattttccagcaagacattagtttaagaaatggaattactatgagtacaagtttggaggaagatttaaaagtctgctgtgccattttgctctagaccaaaagaagtaattactaaaaagaatatttcaggaaaagttacatgaagtatctaactttagtctttgctacatttcatatattcacttcattctttcagtacttctgatgatctaagctgagattgatgtaaaattttttctgacagtaaaaaaaaacaaaaaaccccacctccccaaggagcatgatgtgttgagaaagcattttaaggacacctgcaaactttggctaaagaacattcacaaataagcagctgtgcgaagagggatttccacataaatttccaacttaatgtgagtgggaaaataaatgttaaactctagtagtggagatttcagctaattactgaagacatggagactagggatgttctttgaatttctatagaattgtgagatgatgtatggtctgggaacgttacagctgtaaactctaaatacacaaagttatttagggaaaaaaaaatatctgggcaactggtgaggatccacatctgatctcctttcaaagtagaatcaataaacattgacttttaaaagctagccaaagtaagcagttgagcccatgacaaaagaatcaatttcactgagcactcaatttttctttaaaatgatcttcaaggatgggtctaattacatagaattaactgaataacagtactgctataatgaagttaataagggtcagtataagacataggctaaaatttgtaaatatttcaaacctaaggaccctttaattagaataaaattcttagaaattataattcttagaagataaagtttgagtgaattgtttctgataagctttcatgaacacagtttagttagaggttctctttgtttcttattgttact

SEQ ID NO: 12451 - DNA, 12552 bp, Homo sapiens
acaaattttattgttttggtttgcttttatctcatattcttacatattttcctctattattaaatatgttttaaaattgtaagtctgaatgactttacagtgttttactatatagatatcataatataattaatccaaattttaggacaattaaagctatactacactttgtcattgctaaagctaccttagctaatgtaagtgaagcactcataatactagtaacttataacaatggacacgataatagctataaatgtgtttgttgttactacttaaaacaaatatcacatttaatttgctggcacagaatggcttgataaaatacatacatcagtttatactattttcaatgtttcaaaggaaaccagattcacatcagaataaactagccaagtactgattttgggggagacaaatatgaaattagggttattccctcaaattacctctttttgttgtcgttccagttctctcatgcgtatatctcttgcttctgcccgggcagcccgttttgctgccagccttgcctctgcctgaaaagtaatataaaactcagctttatacaacaaaaacaaaaacaacctgtacaccagatttgaaaataaagaatgggacattaccacgcaaaaggggtgggcaggagaagatattatctatcagcaagcaagtttgattgattgttttaatcaactcttataaactcatttctttctctagttcctaagtctttcctcaaatccgggcctttacctttaacttcttgtttgattacacactcaacacatttcatacagtttgttatatgcctctccaaacttactctttttccagaattttttccccattgattcaatcatataaactagaaacttcagagccaacctctctttcattttggacactgccaataatcagtctccaagtactgacaattctctaccactgagtctctatcaaacccatctcagctttctttattctcactgttcctgctcatttcaggaactcttcatctccccactccccacctctgttttaaaattgagacagaattcacatatcatcaaattcactatttaaatgtatacaattccgactggatgcagtggctcaggcctgtaatcccagcactttgggaggccaaggcaggaggatcatatgaggccaagagtttgagaccagcttaggcaacatgatgaaaccctgtctctactaaaaataaaaaaaatagccaggtgtggtggtgcacacttgtaatcccagctacttgggtggctgagacaggaaaattactcgaacctggaaggtggaggctgcagtgagctgagatcatgccactgcactgcagcctagatgacagagtgagacgctgtctcaaaaataaataaataaatgtatacaattctgtggtttttagtatactcacaggatgtgcaatcatcatgactaattccagaacattctcacaccccaaaatgaaacctggtacccattagtagtcattccccattaaccctttctcccagctcctggcaaccactaatctactttctgtgtccatgcattcgcctattctggacatttcatatacatggaatcataccataggaattcttcatctcttgcttacagttacctccaaatccatctgcctacttccagaatctgccttataatttatcttctacatggttatatgatggacaaatcagcctttcaaaatgtattatttctgatcacatcattccactgcataaaatcctccaccaactccttattacttatggttaaagcaaaaattccacagaacagcacaaagggaggaacagaaagaagaaaggtaaaactgaaataaggctcctcacagtcaggtccccaccttacttccaagtccagtagttccccccttatctgttgtttcagttacccatggttaaccaaggtacaaaaatattaagtggaaaattccagaaataaacaattcataagttttaaattgtacgccattctgagtagtatgataaaatctctcaggacgtcaatcatccctttgtcgagtatatccatcctgtctatgctacccatttgttagctgtctcagttatcaaatcacagtgattgtgttggagtaatcctcattttatttaataatggccccaaagagcaagagtaattctgacaattcaggtatgccaaagagaagccacacagtgcttcctttaagtgaaaaggtgaacgttctaccttaatagaaaaaagaatcatgcactgaggttgctaagatctatggtaagaacaaatcttctatccatgaaattgtgaagaaggaaaaagaaatttgtgctagttttgctgccgcacctcaaacggcaaaagttacagccacagtgcatgatagttaagatggaaaaggcattacatttgtaggtggaaaacatgaatagaaatgtgttctgattgatggcaatcaggtttgctactatccacagtttcaggcatctgctggggggcttggaatgtatctcccatggattggaggggtggggactactctacttgctccacgtgtactgggtgcatcccatctctctccattcctggactctattgtgttctgttacgcctctcttcacaaactgtttggcaggagctgttctcctttctcttattcagtaaaatattaccttctatgaagattctccccagtccctctttcataaagtaaggctctatacccatgtctctattgcggctttattatgttgtattaaaattccatgcttctctcaccccacaacttttatgcctcaaggtctgctaaaaaaaaacaaatgaattgcagggcataggtcacagtatcaaggaaatgagataaggaaatagcttaatgtgccacatgaaacttagaaatcttctgtctgctttctatatggtagtggaatggtttcctctgtccttggtcacatcctaactctgattcagactatcccctctgataactatagttgttgtcttcccatgttgttatattcgtgcccaagtctcatagtaagaataaactcaaccaatgtttaaaaggatctactacattaagcaattatgctaggtgctgaaaatacagagtaaagtatgacatctctgccctaaagcagctcacaaagttgaagaatacagagacacaatgcttatgggaaggaagcatgtaggagggagaaattagttttgcctggcaaagtcacagcaggcttctaagaagcagagagagttaaatagttaactgctactcaactattccaattgtggcaatttcccagtctgtgtaactggtcttttaatagaaaaacccctgcaaagtaaattgtaatctaccaaccgtaagctgtaaccactaacaatctagagaaattagttttctcccatgaattttacactggcctccgtcttttcaaaacctatgctctgcttcaagttatctgccttcttcacccctctatgagtagacactagtttcttattagagttttttttttttaataggaaacacttcaaggcttttaagcttaagtagatagcaaatgtattttaaaatcacaaagcatcaaaactttcaaacctttttaagaaagccctatcaatgtgtaggaattttcatttacatgtatattaaattgtacctgaagcctcctttagaaatttaattcaagaatgctaattttatccttctaagatttgtctgtggccaattctgtacaatctatatatactaaaatgagacttccttcataaaacccaacttagagataattaaaatctattctttaataagacatttttaactacaaaaaggaaaggaacagaaagaacatgggcttcagagacacacaaacacccttccctttgttacttagccaactcagatgttacctcccttggagactgtgttgaagagaggccattaaaaccacatgctttaaaagaaataaacaggatttaaaactactttatctggttctttctatacattattactagatgcttgaagcaacatggataagcaggagtagcaaggagccaacactgattccaacctagtagacgaaatatatgctctataacttattgtgatatattttaaaattatttttgaatagacaattatgggtacataaaacatacttctaggtagttaacactagcatttttacctcagaatacaatcagataaagagctgctacagattcattttaatatacacctcatacatacaaaataaatgggatataacaataaaggacaaccaagatttaactaaattcacagtaaaggctgggcgtggtggctcacgcctgtaatctcagcactttaggaggacaaggcgggcagatcacttgagaccaggagttcaagaccagcctggtcaacatggcgaaatcccgtctctactaaaaatggaaaaaattagctgggcgtggtggtgcatgcctgtaatcccagctactccagaggctgaggcatgagaatcacttgaaccctggaggcagaggttacagtgagccaagattgcaccactgcactccagcctgggcaacagagtgaaactctgtctcagaaaacaaacaaacaaaacaaaataaagttggctaaaacacacaattaccatttgatccaataattccacctatgggtacatatacaaaagaactggaaagcagagacaacatatatttatataccaatgttcatagcagcattattcacaacagtcaaaatgcagaaacaacccaaatatctatcaatggacgaatggatagacaaattatggtatacacatactttggatcattcagccttaaaaagaaaattttgatacatgctgcaacatggatgaatcttgaagacattatactaaatgaaataagccagacagaaaggagtaatattgtatacttccacttaatgagaaacctaaaatagtcaaattcatacagacagaaagcacaatagtggttgccagggactgagggtagggggaaatgggactcactatttaatgagtacagagttccagtactggatgatgacagagttcttaaggatagtggtgatggctgcatgacaatgcaaatggatgtaatgccactaaactatatacttaaatatagttaccatgataaatttcatgttacatatattttaccaaaagaagttggctaatttaaaagtcagaataagatataaattagaagtattcagaagcctaaattatttaaatacttttagagtctttcggctgatatgaccccaactgttataataaagttaatataaaaattcagaaaaattcagaaaaattcaggagttcaacaccagcctggccaatatggtgaaaccccatctctactaaaaatacaaaaattagccaggcatggtagcgcttgcctgtagtcccagctacttgggaggctgaggcagaagaatcgcttgaacctgggagacgaaggttgcagtgagccgagatggcaccactgcactctagcctgggcagcagagcaagactctgtctcaaaaaaaaaaaaaaaaagacagtgaaaatcatgggctttgatcactcccagaacaaatgcattaggttgtatttaaactcacagaacttttaaatttgtagaatattcactgtatcactcaatgaataattaggaatcacataatggacactaagaaagaacttctcggcctggcggtggcctgctccagttcgagccggtacctcactgcatctcgcaagaatttgtggatttgggggtggaaccccattcggaagagcacaaaaaactgctcttaagtcattgcaaagctacagctctggttagccagccacaaagttgtcatgagagtcgtctccacaataccaagagcttgtgtctggcagagccggtatgagatgagacaatgctgtcccacctccgggataaccaggagttttggccagacttttgagcacataccgrgagagtgaggagccagatgacaagcacatactatggcactaagacagattaataaggaacttagtgatttggcccatgaccctccagcacaatgttctgcaggtccagttgaggatggtatgtttcattggcaagccacaattatgggacctaatgacagcccatatcaaagcggtgtattctttttggcaattcattttcctacagactgctccttcaaaccacctaaggttgcrtgtacaacaaggatttgtcatccaaatattaacagtaatggcagcatttgtctcgatattctaagatcacagtggttgcctgctttaaaactatttctaaagttcttttatccatttgttcactgctatgtgatccaaacccagatgaccccctagtgccagagagcacacggatccataaaatagacagacgtaaaagtacaacagaatatctcgggaatggactcagaagaatgccatatgatgctaccttaaagtcagaataacctgcattatagctggaataaactttaaattactgtttaaaaaaaaaaaaaggctgggcacgttggctcacacctgtaatcctagcactttgggagtccaaggcgggctgatcactaggtcaggagttcaagaccagcctggccaatatggtgaaatcctgtctctactaaaaatacacaaattagctgggcatggtggcgtgaacctgtaatcccagctactcgcgagcctgaggcaggggaatcgcttcacccaggaggcggaggctgcagtgagccgagattatgccactgcactccagcctgggcaacagagcaagactcagtctcaaaaaaaaaaaaaaagaacttccaggaaaagagaactaaacatgtactatggtttatgtatttctacattagatacttcctttaccatcataattttgtattatgttcttttggaatttgagaaaagtagatgagatacaataaaaatataaataattttaaaatgagcaaaggatttaaatagacatttctccaaagaagatataaaaatgaccaataagtacataaaaagatgctcaacatcattagtcattaaagaaatgtaaattaaaaccatattgagatacttgatatccactaggattgctatgataaaaaatgtttttcaactgaaaataactaaaattggcaaggatgtggagaaattagaaccctcatatattacaggggtaaatgtaaaatggcacaattgctgtgtgaactgctgaggcagttcctcaaaagttaaacacagtgataccatccatccacctctaaatatgtacctaagagaaacgagaacatatatccacacaaaaacctgtaaatgaatgttcatagcagcattattgacaatagccaaaaagtagaaataacccaaatatccatcaactgatgaacgaataaaccagcgagattatccatacaatggaatattattcagccttaaaaagaaatcgaacactgatacaggatgcaacatgaatgaaccttgaaaacattttgctaagtcaaagaagccagacacaaaaggtcacatattgcatgattcaatttatatgaaatgtccagaataggcaaaaacataaagacagaaagtagattactggttgccaggggctggggaaggggaagatgaggagtgactgctaagtggtatgaggtttctttttgggctgatgaaatgttatgcaattaggtaggtgacagttgcacatctttgtgaatatattaaaaactactgaatatttttaaatggtgaatagttttgatggtatgtgaattatatctcaatttaaattttttaaatagatgagactgaatgcatcaaaaatgcctaagctaaataaatactaaaatatataaaattctaatacataaaacttaatatataaaatgggataaaggggagcttataacctattaataacaagtttggaaaatgctaagttaaacattttttaaaatcagagtccttaataatatgcattatgaatctcaaagaagaggatagaatatatagtatttctcagacttgaccacattactaaataaaccctaaatgatacttcaagggtcatgctccaagaaacacagtttgggaaataatgattaagtaatatatcaggatccaattacaactgtactaaatcttacctttgctcttgatacttataaaattaaactaaattatctgaataatcacctcacaatagaaaacccaaactattcagataatatatctaccatggtttgaccacttacttagcaaggatagatccttattttctttcttttttgggggggtggggggggaggcgttctcattgttcccctcccacttttccccgcgaacatgcagtgccgggttttctgttcctgtgttagtctgttgaggataatggcttccagctccatccatgtccctgcaaaggatatgatatagttcctttttatggctgcacaatattccgtggtgtatatgtaccacattttctttatccagtctatcactgatgggcatttgagttgatgtaactcaaatgtaacccaaaactataaaaaccctagaagaaaatctaggcaatgtcattaaggacataagcacaggcaaaaaatttcatgttcaaaagcaatcgcaacaaaagtaagaattgacaaatgggatctaattaaactaaagagcttctgtaaggcaaaagaaactatcatcagagtgaacagacaagctacaaaatgggagaaaatttttgcaatctatccatttgacaaaggtctaatatccagaatctacaaggaacttaaagaaatttacaagaaaaaaaaaactccattaaaaagtgggcaaaggacatgaacagacacttctcaaaagaagcaatgtatgcagccaacaaacatgaaaaaaagctcaacatcactgattagagaaatgcaaatcaaaaccacaatgagaaaccatctcacgccagtcagaatggtgattattaaaaagtcaagaaacaacagatgctgacgaggctgtggagaaacaggagcacttctacactgttggtgagaatgttagttagttcaaccattgtagaagacagtgtggtgattcctcaaagacctagaaccagaaataccatttgacccagcaatcccattacttgaaggaatataaatcattctattataaaaatacctgcacatgtacgttcactggagcactattcacaacagcaaagacatggaatcaacccaaacgctctcattgatttttaatgtatttttgttatagtaatatcacaatttcttatcaggttttaggtaataactttcctttgctacaaatagcctcctacagcatttgacttctaattcaaaagctaactgagcagcttccaaaaggaaaatcataacaatgagctggatcaaaaaagtgtgtaatgtgtcaaaaggaaatacactattcctaaataagttatttactaataacaaagaggaagtgatatggtaataattctcaccaaaagaatataatttaatgatgctctaagcaattcttataccatattagtttgtggtcagtctgcagttgcagatagagtctgaaacaaagttggcaattaagtaagaaatcccagctggcagtcatcttaaatttccaatatacggcaggaaatgttgccagcgattcaataggtgacgccccttccctttttcttttttctgagttacaacaaactgaaacaaaattgccccagaagttctgttaccagctaacagaattaaacataaaaattccactgcaatgtttcaaaaaataaaacactgaatctgaaccgacatgaaatattgtttccatcaacatttacataccacgtctgaagcatattaactgcatagcccaatgagtatttctataatatagtcatcatatcttcaacattctaattatcctaagtttacattcgaaagattaattataaacttcaatacattataacaagtacatggaactcaagtaacccataaaaatataaagaaaaattaattttggatgcattggatattgtgaaaattgattatataaattggaattatcttgtcatacccaattaaattacagtcatgagatgagggaggaagaaaaggaaaagaaaagcacttagggcacaagcacctgcccagggattatctggcaagccagctgctgaaatgacctgctataaccttaagatcagttttacctagtagctgcggaaacgaactgctataactctaagactagttttacctaccacagtcactcacaaatcagagcatgccagctcccaaaaacttcgctagtgccaatgcattttctttcaaaacaatgcataacatttctctaataaaaacctcaatcttttctttgttctttggacataccaaagaccaatgcagtctgtgtgtatgcccaaattacaattctactgtctcaaataaaatgtgttgttcagagattcatctctatatttgatttctgttgataatatccaactatattttattctaacacactattttagagactagctataacatcttgctcataataaacatctgaaactagttcaatgagtaaacgtctatatctctgtcaaatcggcatttttacaatacatctgtgcaactcagtgttgagaggggatttaccaaacatacctctctggcaatgttactcaaagcttcatcttctgcagaaaatcggtctttcacaggtgttcttttccttccagaagcaggagtccccatcttgtgttcttaatagtcttttaactttgaaagtgatttaactgtgttttcagccctgaagtaaacaaaaacataataacttaaggtatttctttgtgcaattttcatgctcatttatatattcacttttaacagagaaattagtcaccaaatacctcttcccactaccaaattattccaataaattttagaatatttaattttatactaattactaaaactcctacttcttttcactatgctacccacagcaatctgtgtgtattataatattagcctcagaaagctgccatcagcagaaattctacttaaccatttaaaattactatagctgggcagcctggccaacatggtgaaaccctgtctctatcaaaaatacaaaaattagccgagcagggtggtgcatgtctgtaatcccagctactctagaggctgaggcaggaaaatcacttgaacctaggaggcggaggttgtagtgagccaagattgcgccacagcactccagcttgggagacggagcaagactctgtctcaaaataaataaataaataaataaataactatagttatttctaaaaccaatttccatcccagaatgaaaaacatttcagaagttattcagcctaaacttttagaagaaaatgttcaagaggttttactactaagccttatagttacaaaagtaactttgctttttagtgtaatttaagaaaaattccaattaaaccatgacaacgtcaggcacggtggctctcacctgtaatcccagcacttggggaggctgaggtgggcagatcacttgaagccaggagttcgagaccagcctggccaacatggtaaaaccccatctccactaaaaattcaaaaattagccaggcatggtggcgcatgcctataatcccagctactatggtggctgaggcacaagagtcacctaaacccaggagatggaggttgcagtcagccaagatcacgccactggactccagcctgggtgacagagagagactccacctcaaaaaaaaacaaaaacaaacagacaaaaaaaacccacaaccatataaaagaaaaaatgaaggtttattactctgcaattaacaataaccaacactgtccatgttgttaccaggtactataggaggtgctaaaggtacggtgatgaagaaaactgatatagtcaaatgattaagaatatatcgccaggcgcggtggctcacgcctgtaatcccagcactttggaaggccaaagcaggtggatcacctgggatcaggagttcaagaccagcctgaccaacatggtgaaaccccatctctactaaaaatacaaaattagcaggacatggtggtgcatgcctgtaatcccagctacttgggaggctggggcaggagaatcgcttgaacctgggagacagaggtttcagtgagccgaggttgcaccactgcactccagcctgggcaacaagagagaaactccttctcgaaatataaaaaaaagaatatatctatgaacctgttactattacttattagacctattttaacaaaaggaagaagaaaaacccatccaccaggattaaataataaggatgaaaaagaccatctaacctttggttagatggtatttgagattaaagattaccatgaaagaatgcaacccaaatttcatgccctcttttcttctatacacattgctaagaagtatagctcatttagctaaatattccata

SEQ ID NO: 12452 - DNA, 69359 bp, Homo sapiens
ataagattctatacatggatatgcaaacttaatattacatagtggatttggtgtgtatatttggttttgaatcctgagtttactacttactgtgtttaccagggaaaaccgcaatttgttatccttctctctttcatacaacagagaaaaccacaatttgtttaacagtcacataatacatatttaagtcacatgctaagcactacactaaattctgagaatacaacgaggtccctagttacaaagaacttgtcttcatttttcaattagtaatatgtggataaaagttacccaatggacagtctaaggcagaatgactgtgaaggtcaaataagactgtgaaagagcttcaaaaattgtaaaacactacacaaatattcgtttgtccaaacatttattgaaatgccaggcattgtgctaagcactagagatataacagtgaacaaggcttatatggtccctgcccttacaaagcttacagtctagcagtgatcaataagcagtaacaataaagtgtgccaagtgtatgtctgggaaagaacagggtgtatagggaatggatagtaagggcacctaatctagagggcatcaatgaaggtttcctagatgaagtggcatactgagaccttaaagatgaagataaatttgtattgtaccctaagagcaatggtgaaagcaatgcagtgacatgatcagtaagtcttttggagcaatttggttgtagtgtagaaaggaataaaaataaaaaacagggagactaataaggaggctgttgctataatttaggtaggttgatggcctgaattaaaatggcagcattggagaattggtaaaaaggacaaatgaatggttggtagtggtaatgccatttagtcaaagaggaaacatgagaggaggagcaggattgggggcaagatcaatgacatgtagtgcctgagacagcaaagagcatttgttagcaattagatacatcaattagggaagatctagaaaggagatatgaatctgacagtcatttgcatataaatggtaaggaaaccatggaaggaaatgagatcagctagcgagctgacacagaacaaggcagtctaaaacaaatttttttaaaaatacgaagaacagatattgaagggaagaggtgcctgcaaagactaagaaagcacacctggagatggtatctcctcaaagctaaagtcatcaagtgttcaagtgtttcaaggagggtaagactattaacaaggacttagcatagtagagcaatttgagtggcaatacgggacactgggaatacaaatctgtcaagaaaactagtaggaatgagctataggacagtaactggtaaggacctaataattttttttttaatgtacgtattttaactatattcactgctacaacaggaccagtaacaactatatttatttaaaaaaaaaaagactgccatgcagttacagaattacttaatacagaaaacagtaaaatacacttttttctttttctttttttttttttttttttacaaacaagactagcttatagcaaattctctatagctaagggtcaatttaaaatccttggcttatatctccccctcactcaatgactacatgatgcaaactaattttattaacaccttaagcaaaacatactggaatttcacaaaatgtacaagatttcaatatttaaggaactggggttagaaagcagaagtggctttcaggtcttccagtctttctctcaagtaataaagctctgctgtgaatattcaaagctattgggaaattaccggtagatttttctgtttttttttttcggttttccactatgttgtttctctagatatgtaagcttactctattaaccaaaatctcagcttgaccattcttgataagtacctaatcgacatgtaactttttttctgccttaaatatgtataacaggacagagcccttaaatctgattcaattattaattcctgatttacaagtgctatggtgagctaacagaacttatcaatgcctttattgcactttactagccaaatttagaaggttggaattagtctctcctatctagtattctgtcagtttgcccagcttgtacttttaattttgcttctaatggtaatctgccctatcccttgaaataaaataatctacattttgggagggctaattcttcattgtgccaggctgtcccatgcactgcaggggtgagtgtctttaggcttaaatgccaacagaagcccctagtaaatatgacaaccaaaaaagtgcccctacacatttctcagcatcctctggaatgacaggttactgcctctagttgaaagccactggcacaactttggtttttaagctcttatgccatttattttaattgcccagacatcaattccacctaaattcttagtcatagcctggttccttgaatttgctggattagtaaccacagattaaggtgtttcaatagttaagacaggactttggaacaagagtttttaaattgtataatacttgagaggatctatgaatataaattgggtcctgtttataattagttttacataatgaactttaagattgccttttcatggtgaacagaagtttggaaattactgttttggcacaaagcagattatcttagtagaaatacagaattactgcaatctgtgaataagactgcttttaaatatttctacttgtgtgctatcttacatatagaatgtgtacgacagttccaaattttagaataaatccatttctagcatctaacaaaatctgatactgtatcattttaaaacaaagtgtttactttaggcaggattttttaaaataaagcagcaatacccacgcagataagacaaaaaagctaaaatatctcacacctcctaatcctggagtgcaatcttttttcctcatcgtttttgatagggccaaacttgtgtctacagtaaaaaaaaaaaaaaaaagaattactaactggcaaccattaagattctatacttaccatagtcctttaataggcaagctgataaaatagcccccagttattaaaaaaaaaatccaaggaaaacccccaataattagtcttatctccaaattgcatgaagtctcctatatctgaaacttaaaaatgattctaatgacttcctctatcagtaatgtgttatcactgaggtgggtgatggggagggaagagggaagaaatctgtcagtattaccttcgaactcagaaatgtttaaaaaaaagtctcaaacattttgatggttagacaaaacacctccactgttatgtatgggcttcctttttggaaacttatgaacttgctatgtgagcttctgcaaattggttcaaaagcacatttaaggagttgataatttaagactatatgaatcagaattttaacactccattaaaataagagctgaaatttttggcatttatcttcagaacacctaaaaaacagactgcaaattcaactcacattaatactaaatctctttaaaattaactatatcataaaagacaatgactttgtcactaaactaagttttaaaaaaggtggcattctcatgtttcagtcccatgctgccatttgagatgaaaaaaaaggcaactgtcagaattttaattgtgatcagtttggacggctggtacttggtactttctcacaatccaaattagtaaacttgaaaactcaaaccaatttttgcttttagaattaaattcttgttgagtttttcaatcttgtactacaaagccttatggattagattcatttctttctctcacaaggtcatcccaaccgggctccatttcagttgtggcaacccgaaacagggcttggagatgctcatctgttaatggctgactcaaagtgtgttggtttcgagtcaaatatgaaaaagccttttcacagatttggttactatcaaacaaggatgccaccttacaggcaacccctttgataattgggtaggattcagcagacaatccagcataaaactgccccaagtctttgattctgtattcattccaaagattagtgtttgcctgaagttttgttagctccaccctcactgaaataggtgcatattcaggtttaaagttaaatggatttgaaaaaagttctaagtcctttttaatgaacctgaggtccttaaaatgtctctcaaattctttttggagacgacagatcaccatttgatacctatcaggatcaaatattttttcatcttccttattttgctgttttagctcatcaacaacttctctgagggcaggaaagtctgttagatttttttcctcaatatgtctttgaaataaattcagcttaacttcgaaagtacaaatatggtcaaaggcagcagcagcaaagactttactaactcgtaattcttcactgagttctcgaaggtgttccataatgtccaccaagaagccaaagtcacaaagccattgtttgtctgagaagtggactgttgttgcccctactgaaaccaagaacgcttccatttcttttcttagagagaatattagttttaaagttttccctctcctaagccaattgttcagacatcgtccattaaccctttcaccatgctctgattcagattccgttagtaaagtctgaaattcaggtcgcctaacgcctctggtcttaatcaaaactatccattcggatatggtatttatgatctgattaacatctacatcataggagctcaacagttccaagtgaagaaatcctgaataatgaatgacattccaacagttggggcttacggccttttctctcatgtatgagacgagtcctgagttctcaccaatcatcctcaaagtatgggtcgtggtcagtccaaccattctctgcaagctaagccctgctgtctgcagggactctaggattgccgacatgagcgcaccaacactgaaatgatgagtcaggttgattatggtcagaagatcttcttgcacctccaactcagggcctacaccgcggataaagaccaggaggtagttctcataggccacaaaagcctggtcgtccaaggcaagagaataggctttaaagtccctggctcggttaaaaagctggttgcgtagattcctgtcaatgctcaggatcctctgccttgtgatatctggagataagtcaacgccttgcaggacgcttacatgctcgggcagtacctctctcagcaacacctccatgcactggtatacaaagtccccctcaccccagccgcgacccttcaaggccaagaggcggcagagcccgaggcctgcacgagcagctctctcttcaggagtgaaggaggccacgggcaagtcgccctgacgcagacgctccaccagggccgcgcgctcgccgtccgccacataccgctcgtagtattcgtgctcagcctcgtagtggcgcctgacgtcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaawkgtmgttcgtggcaggggttattcggcggctggacgaracagtggtgaaccgcwtcgcggcggggkaagttwtcyagcggccagctaatgctrtcaaagagakgattgagarctggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggraaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccrctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttsctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatycacaagtattcaagtgattgttaaagagggaggcctgaagttgattcagatccaagacartggcacckggawcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaaggtaaaatctttagctttttttctgaatatggtgggatactgttagagggttttaagcagaggttacgtggtgtggtgagttttttttttttaatcctttgtctttctgtgtggaaaatagcaggacagggcagaagcagtctgtcctgcagactgcttggtcgcagtagagatgtaagaagcagtgagattctgggttaattatggaggcaaagttctcagaatttgctgatatagggtatgagagaaagaggaatcaggaatgatttcaaggttttggtctgctaaatggaaggagttgccatttactaagatgggaaagactatgaaagaagcagattttcagagagatcagaagttcattttggggcatgttcaatttaagatgcctgttagttggatgtttatgtgagtttggaatgcagggtagagatttagggatgaatatttggtagttgtctgcattttaatggtattaaaagccacgagaaggatgggcatggtggctcacacctgtaatcccagcactttgggaggccaaggcgggcagatcacctgaggtcgggagttcgagaccagcctgaccaacatggagaaaccccatctctactaaaaatatataattagccgggcgtggtggcacatgcctgtaatcccagctactcgggaggctgaggcaggagaatcgcttgaacctgggaggtggaggttgcgatgagccgagatcgcaccgttgcactccagcttgggcaacaagagcaaaactccatcaaaaaaaaaaaaaaaaaaaaaaaaaagccttgagactcacctgaaaagatgctcaacattattggtcattaggaaaatgaatgaaaaccacaatgagataccacttcacacctattaggatggctattatcaaaaacaaaaacaagtgtttgcaaggatgtagagattggaattcttgtgtattgctagagggaatgtaaaatagtgcagggtgctgtggaaaatgctgtggtgattcctcaaaaaattaaacataattatataatccagtaattccacttctgagttattcccaaaagaagggatgcaagcagatatttgtacactcatattcatggcagcattatttacagtagccaaaaggtgaaagcaacctaagtgtccgtcagtggatgaatggataaacaaaatggaataatttcagccttaaatagaaataaaatgttgacacatgttgcaacatatacgaaccttgaagacatcatgttaagttaaataagttggtcactaaaggacaaatattgtatgattccccttatgaggttcctagagtagtcacattcatagagacagtagagtggtggttgcccagggccggggggagcgaggagaatggaaattattgtttattgggtacagagtttctgtttggggaagatgaaaaaattctggagatggatcatgatgatagttaacacagcagtgtgaatatagttaatggcacagaactgtacatttaaaaatggttaagatggaaaattttctgttacatatattttactgcaatttttttaaattttattattatactttaagttttagggtacatgtgcacaacatgcaggtttgttacatatgtatacatgtgccatgttggtgtgctgcacccattaagtcatcatttagcattaggtatatctcctaatgctatccctcccccctcccccaccccacaacagtccccagtgtgtgatgttcccctttctgtgtccatgtgttctcattgttcaattcccacctatgagtgagcacatgcagtgtttggttttttgtccttgtgatagtttgctgagaatgatggtttccagcttcatccatgtccctgcaaaggacatgaactcatcattttttgtggctgcatagtattccatggtgtatatgtgccaccttttcttaatccagtctaycattgttggacatttgggttggttccaagtctttgctattgcgaatagtgctgcagtaaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaagatcgccattctaactggtgtgagatggtatctcattgtggttttgatttgcatttctctgatggccagtgatgatgagcatttcttcatgtgttttttggctgcataaatgtcttctttcgagaagtgtctgttcatatccttcactcactttttgatggggttgtttgtttttttcttgtaaatttgagttcattgaaaaattagaatttttttttttttcccttttttagaggcaaggtctcactctgtcgcccacactggagtgcagtagtgtaagcatagctmactgtaaccttgaactcctgggctcaagcaattctgtcatctcagccagctgaagtagtaactgtaggttcacaccaccatgcctatttttgtttttgtagaaatagggccttgctttgttgccaaggctggtcttgaactcctgacctcaagcagtcctcctgtctcagcctcccaaagtgctgggattataggtgtgagccactgcacccagccttggagatttttaataaagaagcttgtcaattaaacaaacaacaaaaagccctgagactgaatgagataatcaagagagtatgtgtagatagagaagaggtccaaggaaggagtcttgggtgactctgatgtcaagtgaggacatgaggcagaaacagcagtgactgagaaggagccacctagtaagaaaggaggaacaccaggacagtgtggtattctggattccaaacaaggaagttactgctaattttaaagctcttctcaggctgggcatggtggctcacacctgtagtcccagcacttcgggaggctgaggtaggtaaatcacttgagctcatgtgtttgagaccagcttgggcaacatggtgaaacctcatctctactaaaaatataagaaattaaggccaggtgtggtagttcatgcctgtaatcccagtgctttgggaggtcaaggcagccagatcatttgagatcaggagttcgagaccagcatggccagcatagtgaagccccatctctactaaaaatacaagaaaaaattaaccragcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtraactgcagtcctttgaggatttagccagtatttctacctatggctttygaggtraggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatgacgtataggagtatatgatttagaaaacggattaaaatataaaaggataaaataggatcttatattttgtgactcacttcctgttggatatctttctacccagtaaatatagtcctatctaggttttaatggctacatgtatgtactgtagtttgtttaaatggtttcctattgaacatttatgctctttgccattttttcctgtttaacgttctgtttttttttttgtttttttttttttttgagacagtcttgctctgttatccagactggagtgcagtgacatgatctcagctcactgcaacctctgccttctgggttcaagctattctcctgcctcagcctcctgaatagctgtgattacaggcgtgcaccactatgcccagctaatttttgtattttgggtagagacagggtttggccatgttggccaggctggtcttgaactcctgaccttgaatgatctgcccgccttggccttgcaaagtgctggggttacaggcatgagccaccacgtctggccttgtttaaggtcctgatgagtattcttataggtacactgtgtttcgtttaattatttccttaggataaatttatagaaataacattccttggtaaaagaatacatattttaaaaactgtattagtttcctgttgctgtcaaaaaatttccagaaacttagtggcattaaacaatacaaattaattattctacagttctggagatcagaagatacgggtcttactaggcctcactaggctaaaatcaaggttttggcagggctgtgttcctctatggaggttccaagggaccagagaaactactttacagtagttattttaagggaatgaaagtgaagatggggttgggcagtcaaagaggctgttacttttcatttttggcctttcagtagtttgaatttttttatcatatacatgtattactttaatttttaaaaagtaaaaagcagctgtgattcagtctctgtaatttagatcaatttacatcaaactagggtggtctcatgtgttgtcttgctcacagtgaccactagattattccaagaagggacaatttccaagacttggtttacactgagacggctcctgattttaaggataccttagatcaaactctaggaaggcagtttsattttggccttgcagttccctgggtcattttccaagcccatggcctcctggagtcttcgcctagctgtaggttatctttgtggctattatttcactgtaattatacaggwagatttattgagggatttctgtgtaccagccgtggttctcagcactttgtatactttgtattaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagacggagtctcactctgttgcccaggctagagtgtagtggcatagtctcactcactgcaacctccgcctccgaggttcaagtaattctcctgcctcagcctcccaagtagctcggattacaggcacatgccaccacagctagcaaatttttgtatttttagtagagattggtgtttcaccatgttggccaggctgttcttgaactcctgacctcaggtgatccacccacctaggcctcccaaagtgctgggattacaggcgtgagccaccccacccagccttatattttttaatgatgcacattagctcaattacataaaccagggaaatccagctaggacctggtgatttctgagcctgacccatgtgmctttcaatgaactgaacttgccacagctgtatttactgtctactgagatgctgtcacacagaccccgtcatagcacagttcctgagttacatctttacatactgtagtatccttcttgtgaaaaaagatacagattccaaaggtctgagaaaccaatcttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcakaagccatgtggctcatgttactattacaacgaaaacagctgatggaaagtgtgcrtasaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcytgagccaccagctcccaccacctgtgtatacctgtgctagtttgccttcccacaagtagctgctggctatctgttatgctggtacagttttcagaaactgatgaatggcctttgaacagaacaaaaatgagattcagaataacaaaattgcacctttgtttttataagcactggccattcactagttgaagactggtaggaatacctaattcatgccaaaagaaagataatttttaaaaatcacacaggttgtttgtagattaaaagggaaaataggctaggtatagtggctttgcctgtgagtttgggaggctgaagtgggaggattgcttgaagtcaggagtttgagaccagcctgggaaacagagcaagaccccgtctctacagaaaatttttaaaaaattagctgggcatggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcacttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatagcaacatttgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagascaagttactcagatkgaaaactgaaagcccctcctaaaccatgtgctggcaatyaagggacccagatcacggtaagaatggtacatgggagagtaaattgttgaagctttgtttgtataaatattggaataaaaaataaaattgcttctragttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtctctttcccttctatgattacacaaagcactccgctgtcatgttatccatcccgcccctccattccaagtcccatctagagcacatcttcttgaagtccactgtaacctgcctaatcctggatgtgacgagccaggcaggaggcagaaaagaatgtgtgttttgcaatacatgttaagagacatcttgggctgggcacggtggctcacacctgtaatctcagcactttgggaggctgaggagggcggatcatctgaggttgggagttcgagaccagcctgaccaacatggagaaaccccatctctactaaaaatacaaaattagccaggcgtgatggcgcatgcctgtaatcccagctactcaggaaggctgaggcaggagaattgcttgaacccgggaggcagaggttgtggtgagttgagatcatgccactgcactccagcctgggcaacaagagtgaaacagggtctcaaaaacaaaaacaaacaaacaaaaaaaatcttttaccacggtgaccaccatgtgatttccaagaacttcaaatgatctaagaaattttgtgattattactagtttgaaaaatactttttttttttttgagacaaagtctcactctgttgcccaggctgaagtgcagtggtgtgatctcagctcactgcaatcactacctcttgagttcaagcagttgtcctgcctcagcctcttgagtacctgggattacaggcatgcgtcaccatgcccggctaatttttgtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaayatagccacgaggagaaaagctttaaaaaatccaagtgaagaatatgggaaaattttggaagttgttggcrggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatggaatagaggtagtttcctaaaggaagatgagaggctgttaccaggaggaggagaagggattcaggacagatgaaaacaacgttatatccatgatagacttacgctgctggtacagatggtacaggtggcttcagtataggctctccgaacccacatatcattgattatgatagggatatgttaactatttttcagtgtatatatgtatatgtgtgtgtgtatatatatgtatatgtatatatatatgtatgtgtatatatgtatatgtatatatttatatatgtatatgtatatatttatatatgtatatgtatatatttatatatgtatatgtatatatatttatatatgtatatgtgtgtatatatatatttatatatatgtatatgtgtgtatatatatatatttttttttgaaacggaatttcgctcttgttgcccaggctggagtgcaatggtgcgatctcagctcactgcaacctctgcctcctgggttcaagcgattctcctgtctcagcctcccgagtagctgggattacaggcacttgccaccatgcccggcaattttttttttgtttttttttagtagagagggggtttaatcattttggccaggctggtcttgaactcctgacctcaggtgatctgcctgccttggcctcctaaagtgctgggattacaggcgtgagccaccatgcctggccatttttcagtatttcttttttttttttttttttttttttttttgagacagagtttcactcttgttgcmcaggctggagtacaatggtgtgatctcggctcaccgcaacctctacttcccaggttcaagcaattcgcctgcctcagccttctcaagtagctgggattacaggcatatgccaccatgcccggctaattttgtgtttttagtagagatggggtttctccatgttggtcaggctagtctcaaactcccgacctcagatgatcctcccgccttggcctcccagagtgctgggattactggcatgagccagcgctcctggcccatttttcagtatttctaaaaaaaatctaaagtgggtcaaacatttcaccttaatagaatgacaggtttgtacatcaagtttctttgctttttcttggaattttatactttttttttttttttggagacagagtcttgctgtgttacccaggctggagtgcagtggtgcgatctcagctcaccacaacctccacctccaggttgaagcaattctcctacctcagcctcctgagtagctgggattacaggcacatgccaccacacccggctaattttttttttttttttgtatttttagtagagacagggtttcaccatgttgtccaggctggtctcgaactcctgacctcaggtgatccgcccatctcggcccaccaaagtgctgggattacaggcgtgagccactgcacccggcctttttcttggaattttatcaatcagtgtcagaatattcattacctcctaaaaataaaggagttctagttggctgttttgattctaggtgtggtaaagtgaaatattgttacttaataaatgcattttgctagacacaatccttcggttcacgagctctgtagagaaaagagaaataaccgccaaccaagaaaagattgggagatactagaataagacccaggggcaggaagaagccagtgagaaggagggcatgttgagagctctgagagagaataaaagcaggggttgttggagctagcttctcaagatgtccttgaggcaaaccagacctttgggacactctgaaaataaaactgaaagtgaagagattgtgggccgaatgtggtggctcacgcctgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaawaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggasagacagtagctgatgttaggacactacccaatgcctcaaccrtggacaatattcgctccrtctttggaaatgctgttagtyggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcaycgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattycacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatgrttacatayccaatgcaaactactcagtgaagaagtgcatcttcttactcttcatcaacygtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaattaattaggatatttctcaaattcctttacagtttttgtctctctgctgatatagtgtttacatgattgttatttactaaacaaatgctattttgtattgtgctccttataacttaattgtttattacaaggttttgatggtgacctaccaacaacaagtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaamcacattctgttaaactgatgtctattagcagggtttttcctattttattaggaaggacttacacctratatataacaaagcttgttttaatcaaggctcagaaaatgtttttcattagtttttttcctaaccatgaagaataactgctttrtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctsaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatmtactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagcygcggctcccgaagcrcctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttktctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatyrtctggtagratsaacttccttgagaaaagccatagaaacagtgtatgcagcctatttgcccaaaaacacacacccattcctgtacctcasgtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccctgtctctactaaaaatacaaaaattagccaggcatggtggcgggcgcctgtagtcccagctactcgggaggctgaggcaggagaatcgcttgaacctaggaggtggaggttgcagtgagctgagactgtaccactgcactccagcctgggcgacagagcgagactccatctcaaaaaaaaaaaaaaaaagactgggttctgttctgtggaggttcttgtcttaacatatccactgttgattgcccagatgttgatgtaattaatttagcagtcgtaaatagtttagcacttgcattaaatagaccaaaccccatagtaggtatttgaaatacagaataaatgtgaggtacccctgctctaaaggagtttatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttgagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacrtggtttcatcatgttggccaggatggtctcgatctcctgaccttgtgatccaccygcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcrtctggcctcaaatcttctggccaccacatacaccatatgtgggctttttctccccctcccactatctaaggtaattgttctctcttattttcctgacagtttakaaatcagtcccyagaatgtggatgttaatgtgcaccccacaaagcatgaagttcacttcctgcackaggagakcatcctggagcgggygcagcagcmcatcgagagcaagctcctgggctccaattcctccaggatgtacttcacccaggtcagggcgcttctcatccagctacttctctggggcctttgaaatgtgcccggccagacgtgagagcccagatttttgcctgttayttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttacaagcagtcagtgaacagaaagtgtctggtacaggttctaagtgcttattattctaagtcacttcacttacctgagttctcagttttcctatctataagataagcaggttggataaaatgttctccaatatactcctggtcctgagatgatgtgattgtgggcagccctttaatcatggtgaagatgttcatcataagcacactgaaactacaaaataggaatataaatattttctccattaaattatgctggatcctagaagcaaaaactggaactgtgaaaccctacttcacagaaaacttaaaattcccaagcagatgaatgcttctcggaaggacactgacagttacctacctggaaagaatctagatggaggtggcatgggcactaagyggtgagattaaacccagttagggcagccccaccagccttggaacccacacatctggagattgttgatgcagagagaaaggttcctactggtgagacctgaaaggkatatgtggcaggtgggaggaagaagttctgtctggaaaccaacccttgttcctccgttattgattgactcctggtaccaacatgagccctaggtcttatagaggccataagtccctatgccttatagtgcccatggatgagatgaggccacacatgcccccagtgggttaacatgtctagcgtgggtaaggctcttggagcactatgatacacaggaaatgcccagtaactcttagttggtttgatatctgttcccattgctcacttaagctcagtgcccctttactgatccttttattctgcctccctctgcacatgtgcattgagactcctatctgagacacacactgtgttgggtgcccagggatgcagcatagatgttgctgccttccacagaagcgctcatggtctgctagagaatatatcccatgggagagaaaaacagactcgggagaatatagcaggggcccttgtcctggactttggcagttaggaaagggagggaagagacatggaggctgggacccaaaggctaaataggaatttgctgggccaaaggggagggggaatgaaaagagtgtttctggcagaggaaatggcaaggataaaggcctggaggcgcaagagaatatgtgtttgaggatctgaaagttgagtgcagtgggtccagtgttctctaccctggctgccattagaattacctgggaaacttttagaaaattccagtgtctgggccctccctaaaacaataaatcattcttgggtggtggggtctgggcatcaggattgtttaaaaccctccccaggtactgtcatgtgcagctggggttaagctgtgctggggtctgagtatggatctgttagggcaagtggcggtgatggagttgaggctgcagaattcaggccaaatagagaggttttcatcaggatattaaagagtttagatttcaatttggtgggaatggatgggatcttatttgcattttatgaagagctccctggttgcaatatcagaatggattggagaggagcaagatggaagcctacagtgatttgggagaagtggtgagggacttgagacacaggaagtagccccattcactaatagttgagtatgtagatttgctaggacctggaaatggtttggctggtggggagtgggaagaaaggcccaaagtgtgaaatgaagatggagagcacattgcctagcccagagtgattgccatttgctctgtcccagttgaggtccaaggggttggccagagatcatggagtctgtggctccatggggagaagaacctctcagcatgcctccttgtcttatcctgggttagtcagattcattttgttagattacattttttttccagtggaactctgcttaagtcctgaccagtatgttttcagaaggatcagagggcctgcccttgtccattggtgcatgacaycagcttggtgggttccttgctgctccctgttttcatagggttatcagaataccttctctccctgccaccagcaggtcacactggctcctgactttttggcccatggaaccaccatctttctgcttcttagattgtgccttgtactccactgatcatggccagtacatcagaagccctggtttgcagtgaatgcatttgatatggaaatcaggaaccctggggataccactcatcatatttggttgctgtgtttttcctccaatctttcaccataacaacaatcaactcaaaagatttctataaccacttgtgtgggggtttctccccacacactaaacaagcagtcagttccagagtggacagcagctggtctcctccaatttaattccaacactgtctacttggagatagcattagatcccacaggttgagggtgcagtcccmtagactgcccccagtctcctgcttcagacaccagtcacaagtccaggactctagaagttctgaccagtttcaagttggggttcccacaaccccccactttatttttgattaatttgctggagtggctcatagaactcagggaaacacttagttttctggacttattacaaagatttaaaaagataccaataaatagccaaataaagagatatacagggctagatctggaagggtctggagcgcaggagcttctgtccccatctacttggctcccagcagatggatgagttcttattcattttcttgtcagcttcgacatgttcagctctctggaagcccgcaaactcttgtcttcttgggccttttatggagacgtcgttaggcaggcatgattgaaacatggacaactgtgtcgaaatatgattggacataaaggggtctaaactcagtgaggcctgtttgttcagattcttcttggcctctctgtggccattctttcctccaggatatggggcaggacccctatggaatgagggtcttatgacccacaatcaaattagagtcctgccttgggcaagtgaaaggaaagcaggagaaggtaagagaaattctgttgcctaagaccttctgaggcctaaagcaccccaacattataacagaagacgataacaggactatgggagttatgagctgggaaccttggacaaaaatatatacatattaaataaatattaagtgtatatatatacttacrtatattaagtgtatgtgtgtgtgtgtatatatatatttttttaatttactggttggttttgggaagcagaaattaccataactactcttaaaaatcttttaagtctctttgaagttagaaaagtcactgtacctttttgtttccattggccctgtacttcttattataccccagcaggaggagcataatgtgttgttatatcattctggtgataagattcataagtgggttcagctggtgacagcctgattccctcattgtaaacttatccatcaacatgtagcttaatcgtttcaccttttgtgatgaccattacctgaatcagttatttcattagattgcaagattatgcttttctgattttatcatttcttctgtattgactgtaattctttggtatagaagaactttcccttgttaatagctatttggttgtcctgaagtacagttcttactagaaagtaagaccaaatgctgaattatatccctctagctatcaattttcgaaggaatgaatggtgtcctagtaatttccagtggtgtttaattacgttttcccttctctttctccttctcttattccctccctctccatctcctccctcctcactttcagttttttgctctttcagtattttgtcatagctgttaacagagcaacatattttaatcaattgtagtcatttttctttttggtgctcaaattatcccgtcttagtcccatggaagcaagcccttggagctagggccctctaccttttgatggatttccatttgtcttgataatttccttgtttctgacaagacaagatgttgcaggcacattttatactttcccagcccaaaccctggaataggccttttctccgaggagctctagttcattttagtgggaaatggtatttagagactataatctgggatctgggagtcctcattgctactgagtagtcattacttttaggcttttccagtggtcagagctaggaaatatgtatatttaaaaatggacagttgaatggttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggwtystacagattcccgggaacagaagcttgatgcatttctgcagcctctgagcaaacccctgtccartcagccccaggccattgtcacagaggataagacagatatttctagtggcagggctaggyagcaagatgaggagatgcttgaactcccagcccctgctgaagtgrctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatcccagcactttgggaggctgaggcaggtggatcacctgaaatcaagagttcaagaccagcctgaccaacatggtgaaaccccatctctactaaaaatacaaaattagccagacgtggtggcgcatgcctgtaatccccgctactcgggaggctgagacaggagaatgacttgaacccgggaggcggaggttgcagtgagccgagatcgcgccattgcactccagcctgggcaacaagagcgaaactccgtctcaaaacaaaygaacaaacaaaaaccccaaaaatccctgaagtacgtgagctagtggtgaaagaaagctggagaaaaggagcaggaataataataataataataataataataaagattgtcatttaattttgagtacttccagtgtacactttgcaggtactctaagacattacctcactgaaatctctaaggtagatattctttatttaaagtgtacttgtatgaaacctggagctcaaggtgaaggaatttgcccaaggctgcacttgcactatcgtggcactaattagccgtgtgaactgggacacgttacttcagtttgctcatttctgagtcagcctagcaagatgacttctaagaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttggggctgcagtgagccatgatcacgccactgcactccagcctggctgacagagtgagatcctctgtctcaaaaaaagaaaaaaaaaaagatttttttccagggaataataaaggaagctaatatttatggagcatctacggtgtgccaaatactttgcatacgttatctcatttaatgctcttatccctgcagggaaagtattaacatttgtttatcacttgcagaactaagtgatatttaccacagagtagacaaatattttcaagcccaaaatcaagtggtatcacttttctgctgagaatgtttcagtggtttcctttgctcttgggataaaacttaaatccctcaccctacccttgctccaaccctccactttccttctcccatgtggtgatttggccatacagctcttgtggctgatctgaactgactgagctttttacccttttgctcttgctgttcttacagcctgggaaccccctggttacctcttggcttggtgtggtggcttacatctgtaatcccagcactctgggaggccaaggcggacggatcacctgaggttgggagtatgagaccagcaagtcacctcttgccagtggcctttgtccattgagtctgaagttctttctcctctcatttccccatcattctattatgctaccttgttttattttcttcattgtgtttattgatacttaaaatgatctcttttctgttgctgtttgactctcccactagaaagtaagcattgtagatcgggcactgtggctcacacctgtaatcccagcactttgtggggcagaggcgggtggatcacctgaggtcaggagttcgagaccagcctggccaacacggtgaaaccccatctctactaaaaatacaaaaaatagctgggtatggtggctcgtacctgtaatcccagctactcaggaggctgagacatgagactcacttgaacctgggaggcagaggctgcagtgagctgagatcacaccacagcactccagcctggaagacatagtgagactctctctcaaaaaaaaaaaaaaaaaaaaaggaagkaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctacyagagaacagactgatcttgttggccttctgccagcacaggggttcattcacagctctgtagaaccagcacagagaagttgcytgctcctccaaaatgcaacccacaaaatttggytaagtttaaaaacaagaataataatgatctgcacttccttttcttcattgcagaaagagacatcrggaagattctgatgtggaaatggtggaagatgawtccygaaaggaaatgactrcagcttgtaccccccggagaaggatcattaacctcactagtgytttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgtgctgattagagataaaatataaataataacacttgttacagagcaaggagttgacacttttatattctgaagacaaagtggtaaatcattatcatctatgtcagaaatagcttttgagaatacctgagtatagaactatcttgatccctgttacttcaaaactaaaataatggttttaggaattaaaaggtgaggctagtcacctccaagggatgaactgactcagggattgaggtatataacagtgaactggtccaaacaacagtcctgaccccactttatgagtgagactatgagtaatggtctaagtgtagacatcattgtccagggctccagtaggcagctctgtacttgagaatttagcagtgacccttctatttttcatctattatacctttttttttttttttttttgacacagggtctcactttgtcacccagctggagtgtggtggtgcaatcatggcccactgcagcctcaacctccctgggcttaggtgatcctcccacctcagcttcctgagtagctgtaattacaggcatgtgccatcatgcccagctaatttttcttttcttagaggtggggttttgccatgtttcccaggctggtcttgaactcctaggctctcacctctgtcttccaaagtgctgggattacaggtgtgagccaccacacctggcctattacacatttcttaattaaagtagtcaaatttgaaaactgttacaaagtgtatcttaaaatacgacgatctggtttaatttttaaaagatatgagtagccaaggagcaattctgtgcctttcccactagtccctaaccttttaaagcagctgcttcttggctgggctcagtggttcacccctgtaatcccagcactttgggaggccaaggcgggtggatcatgagtcgagatcatcctggctaacacagtgaaaccctgtctctactaaaaatagaaaaaaatagctgggcggggtggcggatgcctatagtcccagctactcgggaggctgaggcaggagaatggcatgaacacgggaggcagaggttgcagtgagtcgagattgtggcactgcactccagcctgggcgacagagcgagactccatctcaaaaggaaaaaaaaaaaaaaaacccatctgcttttgattcagtggcttctttaattttgtcggtctcagtcaccatttgtctaagcaaattcaggcaggcttcaccttgcctttctacatttgttcccttttcttagcattttgggcctttgtttacacgtgggaaaagacccacaggtcgtctctccctttgggcaggatacaggcttcctgtgactgaggttttgctagctgtagaagtggctgccaattggcttctggtttttatttccatgatttgctccagtggctcttcccttccatcattgttagctttcaagctaggaacttttaaaatgcttttaaataaaagtgagctgttacttgatgcatttagcagtcttcctcacagtggttttgatagacagactccctcagtttggaatttatgagttttctttaagggtttgtctccctcatgtatagcaggctgttgaaagttacaatgtcaataactttctgaatagtatcaaactgttttcagtgcagtgtattaacaaaactaacctgcctcaagtttggtcagctttggagtcttactgaggctaaamtgataaatctaaatgatttaaaattgtgtattcctacacagtatctcacttaattatgtaatagtcttgtgagtgagrcagagcagatgccgttttctctattttaaagatgaggaaaatggaatggaaaatggaaaggacagactaattgcaacatcctcgcaatcaaaaacaggcccaggttcatgccttgttggcagtgggttgctactggctgtggccttcatgcaggaaggctagatgcataaccaggtcaacagcccgtgcaggacaagcacgccatgtaattctgattccatcgactgaggctggtgttttcaaacgtgctggtgtagggtcttacagacagagtcatctgtgctatggggaatggaatgtgctcttgctttggagccagaactcctctgaagctcccaccacctacaccattcagaggccagacagaaatttgttcaccattttgggcatgattttcgtgcttttgtaaaatgtgcttcactgcagcccttactgggctgtggtgatgaacacttaagatactgtgtgtgtgctttataatctgtaaggcactgttcaaggggagggacctctgccatgagcccctacccactggtatctggttgacatccaaagccccagcctgggagaagctgattctctagttgaatgctgtatagggatttgactgaggctcagatttggtgaggaagaccactaaccttaacagaccaacaggctggctactccctgatgaagttccccaggccatgaaagaagtaagagatacattccttgtaacagctttcttagttgcacctgtatgattatttgatcagtgtgttgtctgtgcagggatcatgtctgtggagctcaccacctcgtcctcggtgctgagcagagtgcctggcatgtgtactcagtagatatttgctaagggagcgagtcagtgatkgagaggagcagcctgggaggtaaagccctagaatctttattttaaagggatatcaaagttgaacattcagttagacagttctcttgagtccagggatttacccatccatggtggacacactttcagttaaaaagtaaggttaattttgacaggttgcagtatccaggcaagcattctatggaataaggctcatctcagggattagtaatgactgaattaacttactgctagtcccataattttgacgttaattaatggggttaagaaatgtcataagctatttggtaccatttaaagtgaaaatacccttaacgttttttgcctccagatatccacacttaatttcattttcttgctctttggtgaacagtcctgggtctgaatgtatatatccatggtttgtcactaggtgacaggtttttttggaacaagaaatcagttcagtgaacatttgtcaagtatcttctctgtaaaaagtgtaatgtgccaagctcagaagtaggaagtgaaatggataaactatgacccctgccttaaagaacaccatggtgttgtatgggaattgtttaggtagaatgaaagaaatcctctaatagagatatgaggccagttcagcagaaagccagggtgagatctyctgagagggatggaagggtgtcttgatcatctctggtagcagcaaaggcactggcatacagtggccactggaagacaaccagcaggggatgggggcgtttacccttgcaagtgagcattaggaactagaggactgattgycctttcttcagstttggtttcccttgctgcagaaaaagatgctgagactcatggcctcggttatgaactcagatatgtggtttggctttgaagcacagatggattttgtccgattttggcagggaaatgcctacagacagcactatgggcatatttaggttagggacgaaatgcaagttgattaagtcctgataagaggctgtgaagaggtccaagaagcctcacaatgcccaatgaagaaaagccctgtgcttggtgctgccgcctcccttccccgtcctgctggcagggctgcgcttcagtagctctggrtgcgtcagagcagtccatgaacattctgtgtggaaaatctctgactgttttagtggattacactgctctccctttcctccagtgcctcgttattcagtattatttgatgttctccagcttttaaaataatcattttccgcctacgcagaacatcctgtagagacgttgaggttccagtgggaacagagaggaatacttattctaaaaatgaagaaaataaacctttttttatggagtgggtgatagtattgcagaacttctataatagtatgagaattcacttgtggtgccaaagcttaaaaaaaaagtatagtaaaaacataatgtataggcttattgctgtgctatgacccatgccccgttttctccaacctctcttgtcctcactcttcctttttgctggtgatatttttacttatttcatgaaaaaaaagataacatatacacacacatagatatatgcacaagtatatrtatatatgtgtgcataacacacataaacatatacattggtaaatttaaaaacatatttatgaaatatatgtagcatctacagaaaaacatgaacacttgtgagaatagcatctgcctaaaaaataggacatcaccatcacctttgaggctcttatgtgctgctcccctgtgccattcccttcccttcttccttagaggtgattactattctaaattttgggattattatttcctttttttattatagtgttttaattacagttttattacctgtatttgtattcctaaaaatttgtttacttttgcaagctttagattttataaaagtagaattacactgtaagtttaatttttctgtaatttatatatagctacacatatattcctaagattcatccatcttgttacatatagctctggtttaccttttctgtataatatagattctgcttcgtgaatttacagttcattcattcttctgttaaaggacagttggaggactcatatggcctcagtctctgtgtccccacatgccaccctgcttcccagcctcatatgagttgattggtggcctggcatactggatgagaagctctaggtcatatatttaagagagttattgctgggtcataaaatgacagattgttttccagaggggtcatattgatttaaattatcaccaacaattatattgtcagatttttaccagtttggtgattgtgaaacagtgtctgatggtagtttttatttgcattttcttggttgaaataaagttgtgtatttcagccaggygcgttggctcatgcctataatcccagcactttaggaggccaaggtgggcrgatcacttgaggccaggagttcaagaccagcccagccaacgtggcaaaaccccatctctactaaaaatacaaaaattagatgggtatggtgtcacatgcctgtaatcccagctactcaggaggctgaggcacaagacttacttgaacccgggagatagatgttgcagtgagccgagattgtaccactgcactccagcctgggcaacagagcaataactaaataaataagtaatcaattaataaataagtatatttcctcagctgttaagtacctgttcaagttttttacccaatatttgatgggctctttttttgtcttttctaattaatttttggagtttttgatatattctagatagtaatgagttacatgaaaatatccctagtttagggatcctctagtaactttttaaaatgaatacttgttttaggaacagaaattcttagatttaatgtaggcagattttatcaattgttctttacagattggctttgtagcttaagaaatccttcctaactttgcaataattaaagatatgctcttagattgtttcctaaaagactgatacttaagcctctagcccacctggaattgattttcacagatactacattttttactagttatagattggccccttcgtagagcaagtccgatagctgccatttttatggcagcatgtgctcacttagtgtctctgtcaaattttggtaattctcacaatatttccaactttttcattattactatatctgttatggtgatctgtgatcactgatctttggcattactattgtaattgtttggggcaccattaagctcactgtcttatgtgggcataaaccatgcccacataagacagtgagcttaattaataaatgtgtgtgctcagacccctccactgactgggtgttcacatgtcttccttactctcctcaggcctccttattccttgagacgcaataatatggaaactaggcaaattaataaccccacagcgtccacaagtgtttaagtgaaaggaagaggctgggcgcaatggctcacatttgagctcacaaatgagcccatgctcatttgccattccaaaaatcccagggcccttaagaattatgctaactctactctgcctctgctctataaatggaacaacaaagcctagatgacagcacatctttttagaacatgatttactgaatattttaagcccattgtggagacctactgctcagaaaaaaagattcctttcaaaagcctgtaatcccagcactttgggaggccaatgcaggtcgatcacctgaggtcaagagttcgagaccagcctggccaacatggtgaaacacgtctttattaaaaatacaaaaattagccaggcctggtggtagatgcctgtagtcctggctattcaggaggctgaggcatgagaatcacctgaacccaggaggtggaggttgcagtgagccgatatcatgccattgcactccagcctgggcaccagagtgagactacgtctcaaaaacaaaacaaaaaaaaaaaactgaaaggaagagcttaatgagaaaggcatattaaaagccagtataggttgaaagctaggcctcttgtgcaagttagccaagttatacatgaatggtaaagcaaaacagctttattgctgtaataaagaaagttttagtggtctggatagaagatcaaatcagtcacagcattcccttaagccaaagcctaatccagggtaaagccctaacttgcttcaattctttgaagactgagaggggtgaggaagctacagaagaaaacttggaagccagcagagattgatgaggtttaagggaagaagccacaagtgctgatgtagaagctgtagcaagttatccaaaagatctaattgatgaaggtggcttacactaaacaacagattttcaatgtagacaaaacaatcttctattagaaggtgtcatctatgacttacatagttaaagaggaaaagtcactgcctggcttcaaagcttcaaaagacaggttgactctaataggtactaatgcatctggtgactttaagttgaagccagtgctcatttgctattccaaaaatcccagggcccttaagaattatgctaactctactctgcctgtgctctataaatggaacaacaaagcctagatgacagcatctttttagaacatgatttactgaatattttaagcccattgttgagacctactgttcagaaaaaaagattcctttcaaaatattactgctcattaacaatgtacctggccaccctagatctgtaatggagatatataaggacatgaacactaacacagcatccattctgcaacccatggatcaaggagtgatactgactttcaagtcttatttaagaaatacatttcatagggctctagctgccatagatagtgattcttctgatggatctgagccaagtaaattgaaaacctctggaaagaattcatcattttagatgtcctgagaaacattcgagattcctgggargaagtcaaaatatcaacattaacaggagtttggaagaaattgcatccagccctcatggataactttgaggggttcaagacttcagtggaggaagtagctgcagatgtggtggaaatcacaagaaaattagaattagaagtggagcctgaggatatgactgaattgctgcaatcccatgataaaatttgaacagatgaggagttgcttcttatggatgagcatagaaagtagtttcttgagaaagaacttaattctggtgaagatgctgttaatattgttgaaatggcaacaaaggatttagaatattatataaacttggtaaagcagcagcagggtttgagtggattgacactagttttggaagaatttctactgtgagtaaaatgctatcaaacaacatgacaagctacagagaaatctttcatgaaaggaaaaatcaattgatgcagcaaacttcactgttgtcttatttcaagaaattgcaacagcttcctcagccttcagcaatcaccaccctgatcagtcaacagccatcatcagggctagatcctccaccagcaaaaagataacaattcgccgacagctcagatgactgttaccattttttagcaaaaacctttttaattttatttatttatttattggagacagagattcactctgtcgcccaggctggagtgcagtggcacaatctcagctcactgcaaccaccacctcccaggttcaagtgactcttgtgcctcagcctcccaagtagctgggattataagcatgtgccaccacgcctggccaatttttgtatttttagtagaggcaggattttactatgttggccaggcttgtctcgaactcatgatctctggtgatctgcccacctcgggttcccaaagtgctggtattattggcatgagccactgcgcccggccagcaaaaaagtgtttttaaattaagctacctacgttgattttagacataatgctatttgcacacttaatagattacagtgtggtgtaaacataagttttatatgcactgaaaaacaaaaaatttcacatgacttgctttattgtgatattgactttattcctgtagtctggaactgaacctgcaatatctcagaggtatgcctgtatctacttgttctgtgatacttgttattgtcagtttgtttggatttaccacatattatttgatcataattctttcctgtagatgttttatggtctgcctaaacctttagtggggcctttgatggcttagtcctttcaggcttaagacaatagaagtttatttctcagagttctaaaagctgggaagtccaagatcaaggcaccgacagatttagtgtctagtgaaggcccgcttcctcatacatggcaccttctagctgtatccttacatagtggaagggaatagctagctctctggagtttctttcataagggctaatcccactaatcccaattatgagggaagacctaatcacctcccaaaggccccacctcctaatagtatcaccttgggggttaggatttaacatatgaattttgtggggacacagacattcaaacaatagccatggcaaacttttttgctttgtctaattcactcttattttgaaaagtatttgtgttgggtttaaaactccagattggtaattattttttcttagtgcattgaaggtaatagtgtatcattttctgatttctactcttgctcttgaaaattcagctatcaatcttaaaatttattacctgttgaaaatccagctaccagtcttatattttatttacttagtgggtaatctctcttctgagtacctttaagatctcctttcagaaataccatgtagtaaccctgtgtgtcacgtgtggattttgttgggcttgctagctgagacttgacagttttcatcacttctgggatattctcaggtattttgtcttcaaagtcttcagatattgtcctcttcctgccctctctccgactccttctggaacatgagttatgtatttattatctcccatgtgcataagttatctttacatattttcaatttctttatctttctgtgctacattctggataattttgttgatctaccttccagttaattagcttgttaactttgtcaaatctctttttaagtctatcttgatttttcttttcaattattgtatttttcatttttaaaaactttatgtgctcttttggaaatcttgatcccaggagatagtggatagtgtcctgctgcttactcatggttttaatagttcttgagcatgctgaacatacttattttatgttatttgctaatctttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgrgccttggcacwgcatcaaaccaagttataccytctcamcaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtargtgatgcaagagaaagaagacctgatgccttctttcctcccagctttgagaatggagcaaaggcctaccccagccaccaagtgagccagtgggcttgatcagcacaggaaaggtgaccccggcagtttcatttgactattgcatggctggcaacatttctattgattgtttccagggaccttggcggatgagctcctgttgagtctagcatctctgttaaatctgttctcaaataggtaatgcatatgggaggatgctgccaccttgcatctactagacatcacctatctactgtgagactctccctctaagccctgctgtggcctcagagtgcttattggccctgtgagtggggcagccactatacattgcatggagttggtacatgagatagaaacctattcgccatcccttgaaactgccccagtccagaagcttcctgttagcacatgtacctccttgtatgtattcagaactcattccatttaggcttggaaacccgtttggtgcaactctgttcaagttccattgtctgctttgagaatgcttgggcttgtatagtragctgtcactttttaatttgttaggaattctactcgccttgctttttcttttccagcatgtttaagggaatgacctccaaggccccaaatcacagttgtattcatgttctttcatytcacagatacaatccaggccagtcccagatttgcagctgttaataaatgtgaatggttttccagtaagggggtagaaaaacatagggagagaaccgggttcagagttcaatatctggattcaagtccttcctttagcactttactaactgatgtagaataagtcagctactcaataggtgcctcagtttccccaccaaaatgcagacatagaaggtgctttgtctgctttgatgagaagtctttaagcaagtctatggggttcaatgtgttttaagaactataaagtaccatataaatgtggcctttattcccattgtgttcttggaagtaattcaatatagtgtgtacttcatagctgcttttggactattgccagccagtgtatcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcrcttcatttttattttcagtgaakaactgttctacyagatactcatttatgattttgccaattttggtgttcycaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccagcctgggcaacagagcaagattccctcaaaaaaataaatatctactgacacttaatacttggaaagggataaaaataaacattgtctaaagccgtggtccaaacacaacccctgccaacaattttagtccatttcttccaagacttttttttttctatgccttttgtgaaaactgtcaaaaactttttcaatgctgaattttagttctgagttaaaaatcatactacctgtttatatggtttcatatccacttttttcatgtgatatactctacaaaaagcctgctgagattttgattgggattatgttgaatctagatcaatttagggtgaaaaacttttgttagataaatcccttagtatttcacatttttaaatgctaaatggcatttttcaaaaattttcttttttcttttcttttttgagacagagtcttgctctgttgcccaggctggagtgcaatggcaaaatcttggttcactgcaacctccgcctcctgggttcaagcgattctcaaactgcctcagcctcccaagtagctgggattacaggcatgtgccaccatgcccggctaattttttaaactatttatagtagagagggggtttcaccatgttggccaggctggtcttgaactcctgacctcaggtgatctgcccaccttggcttcccaaagtgctgggattacaggtgtgagccactgcacctggcctcaaattttttttttttttttttttaagagacaggggtctcactcttgcctaggctggagtgcagtggcgtgatcataggtcactgaagctttgaactcctaggctcaagtagctaggaatacaagtgtgtaccactacacctggctaattttttwaaaaaaatttttttcgtagaaacgggagtcttgtgttaccaaggctaatctcaaactcatggcctcaagtgatactcttgcctcagcctcccagagtgctaggattgtaggcatgagttacttcacccagccaaaaaacttcaatttcctattgtttatttgctagtatatagaaatacatatagttttgtaccttgatgctgtatcttgcaaccttgttaaactcacttactagttctagtatattttttgtagattctatcagattttctatatatgtatcatgtcttctgagaataaagaaacttttacttcttgctgtgcaaactgaacaccttttctttctttctttctttttttaagacggagttttgctcttgtcacccaggctggagtgcagtggctggatctcggcttactgcaacctccacctcctgggttcaggcaattctcctgcctcagcctcctgagtagctgggattacaggcgctcgccaccacgcccggctaatttttttgtatttttagtagagatggggtttcaccatgtggccgagctggtcttgaactcctgacctcaggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaagratggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaactgcaaattctatttctttaatagtatagagctattcaggttatctgtttcttcttaggtaagctttggtattttgtttctttgaagaaatttgtcgcatttaatctaaatttttaaatttactgacataaagttatttataatatttcttattcttttattatctatggatctcttggtgacataacctctctcattcctaatattggtaatttcaggcttttctttttaacttggtcagtctggctagaggtttatcaattttattgatcttctcaaagaactaacttttggtttcatagatttttctattttctatttcattgatatctgctctgacttttaatctttcttatacctattttggtttaatttgtcttctgtttcacatttctttttttttttttttttttttttttgagacagagtcttgctctgtcgcccaggctggagtgcagtacagtggtgcgatcttggctcactgtaacctcagccttccaggttcaagcgattcctgtttctaagcctcccaagtagctgagattacaggcatgcaccaccagctaatttttgtatttttagtagagatggggtttcactgtgttggccaggctggtytcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatwtatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggrgccagcaccgstctttgaccttgccatgcttgccttagatagtccagagagtggctggacagaggaagatggtcscwaagaaggacwtgctgaatacattgttgagtttctgaagaagwmggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcstttttcctgcaagcaggaagggaacctrattggattaccccttctgattgacaactatgtgycccctttggagggactkcctatcttcattcttysactagccmctgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttayagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcrctatgttctattccatcyggaagcagtacatatctgaggagtcgaccctctsaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggatkcctaatgtttcattgtcacttttcccagtcagatgataatgcttttcaaatcaacatatattttgggggaggttggaagggagagttgaaatattctaagaatcaaagagtagcccactttaatcagagtatgacccctgattgctcacagtcatctcctgagcagtgtgagcgagtttcagatgaggaggctgaaggccagtcaggcatgctcgaggattccaagtctgtaggtgggagggcagagatttagtcctgttggccaaagcctctagggaatttctcactccagtggagaaggcaacacacttaccaaactgtgtggaaactatctcatttgattagaaattttacctcaagaagaggaagracagttgagaaagaacattttcttacacrtgagacagctaaggcttacaagaaggagaggaataatgaggcaaaataatcctcattaatattttcattcctcccctggggattagaactactttcagacccgattttaatggtaagttaggtacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggytccattccaaactcctggaagtgractrtggaayayattgtctawaaagccttgcgctcacacattstgcctcctwaacatttcacagaagatggaaatatcctgcagcttgctaacctgcctgatctatasaragtctttgagwggtgttaaatatggttatttatgcactgtgggatgtgttcttctttctctgtattccgatacaaagtgttgtatcaaagtgtgatatacaaagtgtaccaacataagtkttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcacaggctctgatggcactgaccatggagaaagcttgatttgatcatctggtgtctacaataaccaaagctaattattaaggaaaaaaacttgaagaaagaaaatagtccttacttcatctataatgaggtttttgtttttttgttttgagacggagtcttgctttgttgcccaggccggagtgcagtggcgcgatattggctcactgcaacctccgcttaccgggttcaagcaattctcctgcctcagcttcctgagtagctgggattacaggcacctgccaccacgcccggctaatttttgtatttttagtagagatgtggtttcacgatgctggccaagctggtctcaaactcctgacctcaggtgatcctcccacctcagcctcccaaagttaagtgctgggattacaggcatgagccactgcggccggcattaagtatgagtttttaagttagcccactttgttaatgactatgagtactaatagcttaagataaagaagtttctaggtaatcttgtttgaaggatgatgtaaaaatataaatttaaactgtgagtgacaaaataaacttccttaatatttgcctacatttagagaaatggagcattcagctcagaaaggaagaatgtctgtggttttaaggtaaaatccatattccaagactcagtgaagaaagttcagtgataaagaacagactactctcatcttatgaagaaatggagcaatttcacttggaaagactaggaagacaaaatgttacagacgtatttgttgtgccacaaaataggcaaggtcagttttgaacaataagaactccataaagtagaccagggcatctcagaagtgaggttccatgagcccaggtggggcacaggctgggtgatcttgagtggagaggaagaggggttttctgagcttcaagagctgggccacacagtgtgttggttttagctgggatggagttctagaacaaacctgcactttagaacacctttctacccacccccaaccacacaacttgctactattagtaaatgtataggctgaggcacggtggctcatgcctgtaatcccaacactttgggaggctgaggcaggcagatcacttgtggtcagtagttcaagaccagcctgggcaacatggtgaaaccctaactctactaaaaatacaaaaattagcagggtgtggtggcagacacctgtaatcccacctacttggggggctgaggcaggagaatcaagcttgaacccggaaggcagaggttgcagtgagccaagatcataccactgcaccccagcatgggtgacagcacgagactgtctctcaaaaaaaaaaaagaggccaggcacagtggcccacacctctaatcccagcactttgggaggttgaggtgggcagatcacttgaagtcaggagttcaagaccagcctggccaacatggtgaaaccccatctctactaaaaatacaaaaatcagtcgggtgtggtggtgcacacctgtagtcccagctcctcgggaggctgaggcagaagaatcacctgaacctgggaggcagaggttgcagtgagccgagatcgtgccactgcactccagcctgggtgactgagcgaaactctgtctcaaaaaaaaaagaaagaaaatgtatagaaaatcatctcaattcagaagattggtatccatattttttaaatgaagggctaattaaaaaaggaacaaatattagagattttattcacttttgagttacctttttaaagtctagttttattatcttatgtgcctttagtcactagattttcccccaatatattttctgtgtaagcactttaaagatacaataatcatttctataaaaccacctgggtactaagagcaaaagagaatcataaattctgcaaagtagttgcactccatgattttaaaaaaacctcttggacagggtacctctaaaggtgaaactcaagtctttaaaagttctacattccagattgtttttccttgagaaggagacaaaagaagagggatgtggttgccatgatttgttttaaagtctcctataacaaaatgaacatgtcagtagccaattgtggttggcaaaagggtgtatttaatagaatctgcaggcagatttccaatctgcctgccctgccctaccctccccctttgggtttgtttgaggtttcattccacaaataagcagcagataaaatactttacaaggtacagcacagttgtattgaagaaaaaaaggacccaactcttactttaggagtattaggcctggacttcccctgccccatgcaataaagcaagttttatatacactccccatatttttttctaacattttcttatataaatttaaatattttacaaaaaaaggcttttttcctccaaacatataaatctgagtgaaacatagattccccacccgagaacttgtttcttcactaaaatataaatgttgtctgatattaagggtaaatgtcttttgaccactggagatcactgaagtctgaattgcaccgtggagaaggcacttgtgttttctgaggtctccagcaagtatctcagtgagcactcatagaattgctgtctgtcctccagaacccgtgccaaggcctccgagtgcccagttactgaggcagctggggaaaaacgttgagtaaacatgattctacaattacggagataaaaaataaaaacagcatggactggttctaccctagaatcaaactacaacaaaatccaaagtgttcattcatgtagattcaaaatgacttcattctgtcataaattataaaatacaaaggtggctgttttaatgacaaaactcaaaacagtactaaaaggggtttgtgtcaatggacaaaagtcagtccctctaggtagggccccaaggagcatcacccaggttgaagggtggttttcctactgctgggccagaagtgctgtcctattggccttcatcttctccagccgcttggccaggtggctgttggtcatctccatctcctcaatcttgtccagtgctgttcgtaactggagacagggagaatgcagtcactacatgtggtcagaaacaacatccagtgctactctattttcaacttcctgggaaatgaaagcactgctaactgtgatggccttgcacaggacccacaacctcattttttctatcagttagaggtgttaaatgatgatactgaggattgtttatttgttttaatcacagaaaggatatatagaagttggagaaatagacctgatctgaagcaaaaatacaaactatctttttacttagtatctaattgaccaaaacataaaagtaaatggcagtcactatgcaggtcaaaaaccaacacaaattagttaagtgactccactgctgtttccttaagtatcaaatttcttacacagctaagaattatttccagaagattttttctttttaggaatgtattctccaagaaacatattaaaagaagtacctctcgttgtagcttccgtttttctgctttcaattcatcttcaactttctcagcattctcagcagcagttttatatctcagaacctgtccctcaagccggctaatctgtaagtatgagaacacaggcctctagtactgggcactagaagtcaccactttttggtagccaggatggaaatacaatgtcattataaatgccaagtaatctactaacaagtcccctaagggtgactcataagtcctctcagaactcagttgctatttataaatcaagtaatgtccccagagaggattacagctgtagagtcattttagggccaatttcccatgctaagttttattatgaccatattgtttaagtgccaaagcaatataggaagagacactaaatggaaaagttcttacactttttggaatgcgtaagggattttattacaaatgatgatcttgaattctcctgaaatatctacaaaaactgatagctatagtttcctatggttttagagaaaacagaaggctaaaatgtcccaacaagtgctctctgctggcttttctattttaatacagaactattattgatccaactgcaaaggcaacccaggcactcatgggttgttagccacttagatgcaggaaggacatttaaataacttagtaccatatagaagtacttacactttgctccaaggtagttatatcctgttctgcttttgaaagcttaaatttgtattcgctaatttgtctattggcatctcctagaacagaagaagacaatgaattatcttcacctgtcagagatgacagtatgagccatcaggcagtacctctgtggcacagagaggaccatgcagtcttaagattacaaaatacagggctgggcgcggtgactcacgcctgtaatcccagcattttgggaggccgaggtgggtggatcatgaggtcaagagatagaggcgaccatcctggccaacatggtgaaaccctgtctctactaaaaatataaaaattagctgggcgtggtggcacaggcctgtagtcccagctactcgggaagctgaggcaggagaatcacttgaacccgggaggcagaggttgcagtgagctaagatcgcgccactgcactccagcctggcaacagagcgatactccgtccccctgccaaaaaaaaattacaaaatacaaatgcacacacaacaaccacagcatcttcagcagcccaggttctggactgtatatactacaagatgctctagcatatatgttactacagtatcccttgcagcaagagttagaagaaaattctttaccctatgatatgtgtgagcagggcttgagaaaggagccctgccaattcagcagcagcccctaccaaccctgtgtgtaaccttgtggagcctccctgcccacgggactgggccctctagttccctgaacgcggccccatgccttcccatctcccaggttttgcttctgctgtccaatactgtaagggtccttttctcccacctctgacttgcttcaaggccaagctcaattttcacctctttcatgactccccttaattataagtccttcccttgctgtattttatttgcatttttatgacatttgtcatgctttttaaacatcgtatgtgtaagcaaggagaggggccctgtcttggccttcctaaatctacctatgtacctagccaagtgcacacagtgtatgcctaaataaatatatgttggaataaatgctgttcagtaatgtgataatgtgttatgggtagagctataagttactagatgaacatctgacctaggaagtaaatcacttaaaatgaaaagtttagaaatgatggcaggggacttttaaaatccctccaagaatccaagtttagcaaaaatcagtctctggcatgattacagtaataagatttgcaaaagataaaccaaatctaacataccacaggaaatattcagattatctaacttaagaacttttctacatttccacatgaccaaggttacaattacttatacagtcttcaatgtgagaggtttttctttttttttttttgagatggagtctcgctctgtcgcccaggctagagtgcagtggcgcgatctcggctcactgcaagctccatcacccaggttcacgccattctcctgcctcagcctcctgagtagctgggactacaggcacccgccaccatgcctggctaaatttttgtatttttagtagagacggggtttcaccatgttagccaggatggtctcgatctcctgacctcgtgatccacccacctcagcctcctaaagtggtgagaggtttttctaattggacaattactgtcaccttaaaaggaacagggttaccatctccccaaaagccatatctggtagtgaaagagaagtattcctatttctgagccctaaaacaagcttcagga

SEQ ID NO: 12453 - DNA, 16762 bp, Homo sapiens
acatccgctttgggaagctggaagcttccgatgaagaggtgtacacagccgcccgggaagcgaatgctcacgagttcatcaccagcttccccgagggctacaacacggtcgtcggtgggtgctcgggtctgccgggaaccaggtggtgaggcactgggacacaggattccacaggagcagtgagcagcccagtgggactgagggcagcagggacagctggggagaaagacagttgtgtcagggaagacgagaaccacagccaaaggggacagagtcgttgtgtggggacaggggagtccaggccagtgtggttcagaaccagcagaccaggcaggctgcagagacaggacgggctctaggaggagctggagaatgcgacagagggcatatgacaggctcctggccagggacacagtgatgcatggtgtttggagtcctcaccgagtctaaaaggccgccacttccccagactgaacagaagaaatggggggctgcctcctctccaccatccatccccctctggctcctgtttccttcctgtgcttttcatctctaaagtcgtttctcattagaatcggggtgactggatgggccccaggagagggctctggtggttctgaactaggaacacgcagcctggcactgcagggcgtgcaccttgcagcttgacgtgcggagctcccaggtctttttccagccttcggggccatgtttctcggccagtgtcttggctctgttgcacagtgtttcagcacttctcaggatacagggatacctgggcttctcaactctggtcagtctgagtccagccttctgagctgtggggccagtgtccccagcccagccatcgtgttctagatggctcctccagccgtgttgatacactgtccagatgccagctgtcctcactgggtgctctcccacatctcttttgggtggcactttccttgtgtctctgatcctagtactttctgctcatttgggccttcttggggctgcgtccttactgacctgtcaccctgctgtcaccttgaggttctttttggctcccaggctgccacttgtgctgtcctctgtgggcttcgaatcccacctccctggagtcactggaccccagagcccatgtttgggtgctggatgttccccacagccacagagacccgggaggctgggaaggtggcttggaactgcaggcacagggcagggtgtgggtcatcctggcctgaggcactgccatggctggggaggggcatttggcaactcccttggagtgcaccaagccctgctggcggtgtcacaccaccctcagaggcagggcaagtgtgcacagtggctgagggacccagaggtgggatgagccagtgcagggggaacccagaggaggagtgtacacagtgtggggtggggggtcagaggcaggaggagggtgcacagtgcggggtgggggtcagagacaggactagggtgcacagtgcggggtggagggtcagagacaggactagggtgcacagtgtggggtggagggtcagagacaggactagggtgcacagtgcggggtggagggtcagagacaggactagggtgcacagtgtggggtggagggtcagaggcaggactagggtgcacagtgcaaggtggagggtcagaggcaggacgagcgtacacagtgcggggtagagggtcagaggcaggacgagggtgcacagtgcggggtggggggtcagaggcaggaggagggtgcacagtgcggggtgggggtcagaggcaggaggagggtgcacggtgtggggtggggggtcagaggcaggaggaggatgcacagtgcggggtgggggtcagaggcaggaggagggtgcacagtgctgagaggggcacttagaggatcttgatgggcgttcaggaaggaccctgtgcccctttgtgggccaccctcaagtgcacagcttcaggctcctgccctgcccctcccttcccaggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggttagttgtcctgggggcgtggatcagtgggttgaggatggcttcatcacggacagtggcacaatgctgcaatgagttatatgaagttgtggcctggccccagggccttgggggctatattctggaagcagcgtcccatatagagtcaggagttcctgcattcagccaagccctggcctctcaggccctcagtttcttcttctgtcccctgggatagtataattgcaccatcagctcccaggatcaaaaggaaaagtactagccgggtgcctgtaatcccagcactttgggaagccaaggcagaaggatctcttgaggctagcctgggcagcatagcgggaccctgtctctacaaaataccaaaaaaaaaaaattagccggatgtggtggcatgcacctgtactcccagctactctggaggcggaggcgggaggattacttgagccccagaggttgaggctgcagtgaacaatgattgtgccattgcgctccagcctggcatcagaatgagaccctgtctcaaaaaacaaaaaggaaacatactcagagtatggtgctgggagcaaggagcagggctagctgcccagggtatcaggtgcaggagaagcagcgccaaggaacctgtgcagggagtcaggagtaggaccccagaggccgtgtggcgttggctaacagccactcattcaagccaaggctgaggggctcgtgcagggagacggatcctgagttggagccttgggctctgtaagggggacagagggaatcatgttcttccaaaattcagctaagtaaggaagtggcagtaactaatgcagcatgccagtggcggttcctttcagattgggcattggtttcagagtgtccccagaagggacaccggcctaagtgaccatgggcccaatggctgatagagaggctcagctctctgagggttctgaagcctgcatgccttggagcaaccatccgcccttccctcccatcttccaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctcccaccagagtctgccagagtcattgggctgcaatgggcagagacagagttccccgagacacctccactctattctccctttgcccagacccctccagacctctcaagagacgttctggccagtctccctgccccacccagcagcttcaaattggccaggcctacagtagctccagggaatttttaaaaatcagggtctggaagtgggcctgggaattcaaacctaggctcttcccacacccttgctaggacctcacttccctagactggcgactgactccctctcctgtgtccccactccctccatgggagaaggagcctatcccctggctcaccccgggacccacagtccccatcttccaaacaacctccctcctttctccctgcacagtgaacacagtcctgatttctagatttcacctcccctccccacccacaagggacacaggcctaacagggcccaacacttgggtcagggtaggagggacggggccacaatggccagttcccacgagaagcgccagcctgcctggctgtcttccaccggccctgccctgtgtgcctggcgtctttcacccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatgcagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttaggcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacataatgggtggtatgcagccctttggaaaaatgtaggttttccaggtcctggatatagcagcgtaagatgggaaatcacagaatacccatgttgtgcctgagatggcaggtggggtacccgtggtacccgggagggtggcaggtggggcacccatgttctacctggggtggcaggtgagcccataaccattgtagaggccaacatcctcagaggcctgagtgtggggaggtaggctttgactccctagggagagagggacacttaggaaacagacgggccctggaagtgggacatgaagagtgccctrgccatccagtgtaggctgagatgctaggggcacagaaagaagagatctgctgatgccagccttccaaccatttcccagcttggccaagagccagctctggtattcgtgaaggaacagatcctgggtgaagctagagggaaggccgcagaggcaaaaggagagaggagctaggccaggggtcagcgactgaccctcgcggccagtgtacaggggttgcaactgggagcctagggggccccaaggcatctccaggcccaatctacctctgggcttttctcaagctctccctaggattactgcggtttcctcctggcgcctctcgtcttggacagccatgcccccctccatgctgcactaatggctcagcctggggccctagggacctctcctaccccccagactgctctgtcggccccctttcccccctactgctgaaacccaatcctctgcagcagcgccggctcagcaccgccggctcagcaccgctccgcagcccctgcctgccacggtcagctacgtcccacctggtctgctgcggagtccccagcccagtgcctagcccagtggagccaccgcctgttcctcgggaaggaacagtgggacctgaccggccagatcacctcctccaatcctgccaggctagtgcctccctgccttccaaccttggctgtctcccaccctctcttctcctctccttgcctggcctcctgaatcctatcttagcctccttagccccctgactgactctctctcgcttcttccaagcctctgtagctggttccgctcctgggttctggccatgaagcccacctcaggcccagaggaggcccggcggccagcctcggacatccgcgtgttcgccagcaactgctcgatgcacgggctgggccacgtcttcgggccaggcagcctgagcctgcgccgggggatgtgggcagcggccgtggtcctgtcagtggccaccttcctctaccaggtggctgagagggtgcgctactacagggagttmcaccacmagactgccctggatgagcgagaaagccaccggctcatcttcccggctgtcaccctgtgcaacatcaacccactgcgccrctcgcgcctaacgcccaacgacctgcactgggctgggtctgcgctgctgggcctggatcccgcagagcaygccgccttcctgcgcgccctgggccggccccctgcaccgcccggcttcatgcccagtcccacctttgacatggcgcaactctatgcccgtgctgggcactccctggatgacatgctgctggactgtcgcttccgtggccaaccttgtgggcctgagaacttcaccacggtgagctgacctccctacctatcctgccagggacccagagagccgaccagtccctgcccagcacccacaattccctagccagcacaggctcccccaaagccaggggacctcttccttcctaccagccatggactccccaccccccagtgccactccgtgcagcccaggaagctgtcctccttggggctttctctgtctcccagcccgaggggagcatgtgaggccacactgaccccggctggccctaggcctgaggtctggcccagggaggccctgctcctggggctgggggtcctccatggtgggaccattctggggcagaagacccctatctctgccaggaggtggggggggcttgctttccctctgccttttcaacatactgccagccccggaggacagccacaggggcccatttccttttcctgcagttcccagagaaacacagaaaaacctgtaggctgtgccctgggctttggtggggattggcggggtggaggagctgagttgatgggctcccaagagcgtcctgcaacatgtgcccactggagcgtggggctgggggcattgagatgcgggcttcagtattcaaagaagagacgcaaacataccatgaggtggggagaggtcccatgaccatgtgcctgcctgggggagatggccatcaccctgtctgcccgccccagatcttcacccggatgggaaagtgctacacatttaactctggcgctgatggggcagagctgctcaccactactaggggtggcatgggcaatgggctggacatcatgctggacgtgcagcaggaggaatatctacctgtgtggagggacartggtagggagcacacaaatgaggctgggggagggcacggatggagtgcaaaaggctaggggaaggagaggaggagaggaggtgtcagggtgttcccccagaacctgtgaaaggggctgggctggctcatcccagtcctggggagaggggctgcagtgagaggtcttgtctggttgggcaggagacctgaccacacaggtcaggcctcacaggtccctccccgacagaggagaccccgtttgaggtggggatccgagtgcagatccacagccaggaggagccgcccatcatcgatcagctgggcttgggkgtgtccccgggctaccagacctttgtttcttgccagcagcagcaggtacccttccgtgtgcctccacacctactacttcaagcccacaccacctcrgaccctaaaccctcagctcctcagacctgtctaggggcctctccccagctggcctctcacgctctccgggaagcctccttaaccctgtccccccacagctgagcttcctgccaccgccctggggcgattgcagttcagcatctctgaaccccaactatgagccagagccctctgatcccctaggctccccmagccccagccccagccctccctatacccttatggggtgtcgcctggcctgcgaaacccgctacgtggctcggaagtgcggctgccgaatggtgtacatgccaggtgaggggctggggttttcgtcccatggcgggcagggcccagggagctgaggctgcttctaaagccatctccccggtacccgcaggcgacgtgccagtgtgcagcccccagcagtacaagaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgcttaatctttctggccccgggggatgctgacgcctcctcccaggggtctgtttttttttcctttccttttattttttaatctttacttttaaaaaacagagacggcggggggcgggggaggggaggggaggggactcgctgtattgcccaggctggtctcaaactcctggcctcaagatcctccctcctcatcctcccaaagtgcagggagtacaggtgtgagccaccgtgcccggcctctcccagggttcttgaaaggagtgggagaacccacagctgcttcttgccagcagtgggcaccaggcggtggccagcscacatttgaggccattcttgtcctcagggagaacgtgctggccctggacatcttctttgaggccctcaactatgagaccgtggagcagaagaaggcctatgagatgtcagagctgcttggtgtgtgtgcagggcccccagggctgggggggtgtgggcaggcaggtggctgtaagttgaagggtgaccctgtctccacaggtgacattgggggccagatggggctgttcatcggggccagcctgctcaccatcctcgagatcctagactacctctgtgaggtgggccagggcccccactgcagggggtgggaggtgggaatcagggcccctaggatgagggrgaaggtgtgcactggccacctcccatcctgcttgcctccaggtgttccgagacaaggtcctgggatatttctggaaccgacagcactcccaaaggcactccagcaccaatctggtaacagcccctcttctggagcccttgcctgctccaagggtgctagggcccacccctgaagcctagaccaccatcccgccccagctgaggagaaacaggcaggagggtgtgcagtgacctcgactggtccctgggaggaggaccrctccccacctctgaccctctcgtcctcacacagcttcaggaagggctgggcagccatcgaacccaagttccccacctcagcctgggccccaggtaacacataatggccccctaaaatcaagggagggcaggggcaggctcaggacagtgggtgtgcccgttcccaccccagcactctgctctgttccgaagacctcccacccctccctgtgccgtcaccaagactctctccgcctcccaccgcacctgctaccttgtcacacagctctagacctgctgtctgtgtcctcggagccccgccctgacatcctggacatgcctagcctgcacgtagcttttccrtcttcaccccaaataaagtcctaatgcatcagcctcagctgtttctcttacagggcagagactagccaagccaaggtcagcccaacttaggcattggaagtcttctgccagccatcatccagctggacgtggcttctgaaatgtggagctgggcccttgaacccccatgaatctctaggggagaatggtagcaagaggttatcagtcatttgcacctcagtgtgagtgagtttagccgactgacatcttagagagaagggaggacaggtatcctccaagcccgggttaggtgtgaggtgcagaatcacagtcagcaataaaggtataactggaagaaaactctgcccagagctcagcaagaagaggcagggagaagacggggtgactccactttcaagaacacctgtgtcctgccttacatcctgactcctttcccacatttgggaccaagtgcggcacacagcctgtctccatacaaacaagttctgcctcctcagcctccccacaagagctaaaggccccaggcttgagacggtgggggtgggggtgggggtaggcggagccctcccttcctcttcctgccagtaaggacacaccaggccccagccacaggcccaacttccctctctttcactggaccccaaacattgggaaactgacaaatagggagtgggagggggtgttcctgatggaaccatatctttggggctctcctgtgccagcctgcaggccttggtatgggggggatgatgagggaaaggacaagaggatccacctgagatatggagaaccacaaggagaggcccagccctttcctctccaccctggtggggagcccatccttgctcccctcactctgagggaccacatcaggccctcctgggcagaggaagggagggtgggaggaaggggtgtgcagcgacagtgctgccctgccccaggggtgaggggtgagggtcatggcctcttaaagtagaagagcaaggtgctgtctttgagccagaagcaggattgcggccggcagtaacagaccagagacacctccagcccatgggccctgtagagccacttgaccaccacatcaaccagactgtgggaaaggagccaatttatgaaattaaataaagtccacaaagggagtgagaaattcgggctcaggcaccccaccccggctgggcccagcactgctggagcacagcgcaccaggcacccccactgtctcacccctctcaagagggggcttaaataggccaggccccagcctggaggccgggggtcccggggcctagggcggacagaagtcggagaagtaggggtgctgcagggcctcttctgctgagatacgctggacagggttacacttcagaaggttctggagatgggggaaaggaggtggcaggttcaggacaggtcactgcccagagccctgccttcctgtagtcccactgggcaagtgtcctgacccaccctctacccctggtcacctacctgcagcagatccctccctgtggcattgagtttgggcacgacgttcaccagggatgttgtggccgggtacatcggatagggctgtggagaggcagggagggtcagactagaggtagggggagggggatggaggcgctaggaatgtgaaacgagtgaccctgatgaaccatgacccccacattccccatcacaccttatagtctggcagcttggtcatagagggccactgctcctcggtgggcgtccccagcagtgtgtccacggagtcaaggatcacttgggaaagggccacagctgcatcttcaggggcagggtgagggcctcttcccctcctggggagggattcctcatacccaccgcccacttctcaccctccctttaccctccggcttgagcttgacagaagcagccccaggcaggtcactcgcatatccagccacgtttcccatgacaatcacctaacccacatgctgctgtcctagtcctaatgaaacagtccttgccctgctcccacaaaatgtgtcctgttctctttggctccttcatcctggcatccatctctcacctggagggacaccctctcggcttcacccctcagggcacgctgcctgtctccaagccacaccttctccagtgtgcatttgcactgtgacaatcagggtgtccagcacccctgctctctccccttgccctcaggagaagccctacagaccccatcaccctaccccacaccatcactgccctcacccattgtgctcaaaactccacggactctcccctcccagagggctcaaggcagaggaaagcaaggatatcggaagatcctcttcaactggtcatcgacatcattgccgggaaaaagaggccgcccagcattggccagctctgggggatagacagggggctaagatgtgacatgtgaaggacccctcactctgaggtaccccctgaccttccagctccagtcccagggcctccctcccttcccccagaggggaccctccagaccctatttgtcaactcaaatgggaaagaaggtgcctctgcaacaccccagcacatcacctgcaaagatgcagccggctgaccacatgtcgatggacgtggagtacagcttggccccaaagaggacatccggtgggcggtaccacagtgtgaccacctggaggagaccccccccgaaagggacctcccacttagaggactggggaggaggtttgaggaggaggctcagagaggagaggaaaataatgttttgggtcctggggttggagctgagggactccctcccccaatcccatatcccatcttctagctcacctcagctgagtaacagcggacgggaatcccaaaggctcgagccaggccaaaatcagccaatttcagctccccattctgaagggaatgggaaggggacatggagaagggcctttaaaaagccttgggacagcaccaactccatcctcccagtcctcttccctctgtgctccccgtgccctggccccagcctctccattccccaccttcttcccaagaagtaccctgtttattagcaggttctggggcttcaggtccctgtgtagcacattgcggctatgacagaatcccagcccttttagtagctggaagaggaatgactgggaggagagagggagaagggagtcagacgccctgaacatgcaactgtgcccagcaacgggtcggctcctctcctcaccctgtgcttcgctccaccccacccacctttcagcacctggttcagagtgacaccattcattcgccatccaggacctgctttatactgtgctaggcattagagggaccaaagtaaagaagctggctctggtccccaccttcctggaccatacagcctaatgggccttggcaggtggatcctagatccggcctagatcccagcccatgctgatcttcccttcctggccgcatctgagtatgcacgccgtgaacatcaacataaatatcgtgctgtagtatcattcaggactggctcccctggaacctggaccaaggcatttggtcttgggcctagaaaagcacctggcacacagtgaagcattcagtaagtatgtgttgaatgaatgagtgtatctccttgaacctcattttctcatctctcgagtgtaaataatatcactgacatcagagtgacactgtgcgggtcaaagatgaccacgtgaaaatgctcactaagactggagacccctggaggacagaaacagggttttctcattctctaacaccctagagtgtccctgttcagggcccaaacttagagcccaaggggtgcttacaccgaatgcagactccgaccccagcctgaggggtcccccaacaccactctcctcacctttacaatctcaggatcgaggtcaccattgcaactgtcaaaatacttcttcaggtcctgaaaagggatatgagtgggggaatgggacagagtttaacctcaatctgggcccctataccttcccaaggctactgtcctccaaaccccgcctttcacctggtcacagaattcaaaaaccaaagtcagcttcttgtcgctgtgcaggacgtcatgaagcctagggcaaaagaagggctcagccaggcaggtccgcctgacagacgtccagtgtcagcccccgcctcccccaagcggccacaccggcaaggagcacccgcctcccgcacacctgacgatgttcttgtgcttcagctccttgagtaggcagatctcccggagggcggaactcggcacaccctgcatatgtgagggggccggtgggcagcagtcagatcccacccagcccaggccctcaaacccctccccaggccgtatcccactccccagtcctacctcatcatcgtcatccagcctcacccgtttcagagccacgatctcatgagtctcccggtttttggccttgaacacagttccgtaggtgcctaggggaaggaggtcaggggtcagggtgaggatgcggcactcttccctaagccaggaaatgcctcctgagagaggtgaaggcagcgtctcagtatgcaagggaagggattcagggtgaaggtaggttggtgagctttgtgagtgaggatgtggcaggtggggagggaggagaaggtgcccaccgaggctccaggggctcggcaggaggggcgagtgcggttgccagggcaaggatgtctaaaatgaaggcggtgctccggaagggtctggaaatagtgaggaggggtctgggagaggactgaggggctgcagaaatattgaggttggaggtctgcagcaagaaacgaggctgggggtcggggtgaggttgtccaagtgctgctgaggctggggtgagaaatttcaggaagtgtcgcggttgggaggtcgggtctactgggaacgctaaggttggagtgagagccctgcgggaaatgctaacacggggaagactggtgtctgcacggagtgctgagctagggggccagggctgcagccgctgctgagatcggagcctgtaggcattgctgacggtaagggagccagggcttcaaggaatgccgaaggatctgcagaggagctcttgcaggaacatctcgagattccattaccttccccaatcttttccagtttctcgtatttctgcatcgcggcggccgcggggacccctgcgggccctcggttttaagactctggccccggcgttgcagaggaggcggcacctgagcctccagccccgccccgtctgcccgcgcagggccttctggggcttgtagtcctaaaacgactaggtctccccgcaatgcccgagaccgaggacaagaagactacaacccccagccgtctgcgctcacgctctctgcagcactcgactccagggctccgtttctaccgcggaggcaaaccttggacttcaagtcccaggaagcaacgcgtgtccgttttccgggcgccccgccgcggcgccgtggttcccagtgtgccccgctgttgttattccttttatgtgctcccagccctcttgaaaagggccgctccgggactacgcgttccagaatgcagcggaaatgggggcggagcgctctcggttaggggtttggggtttggcggcctagatcccgggcactggcggcccagcgctgacctggttggtggcattgtgttcccaacggcctcttgacgacctcagcacgggtttccacctctccccaagccacctagtgaccccagaattgactggggaatgcctgtgagcgatgatgacctcacagggaacagctgaccgcagggctgggagaacagctgtgccccttcgaggctggattttagtggagggacacacgccaaagaccccctctctgctgagccccgtttgttgtctcggagcccacccgactctagccgctgaactctgacatgctgaggaaaactgggtggagccctgggggtccccctcagaccccagtctccggaacagggcccactggagtcagccagggtgtggcaggcaggttggttaaccccctccacagacaagaccacagaccgatgctcaa

SEQ ID NO: 12454 - DNA, 13179 bp, Homo sapiens
aggcctgccctctctatctgttcttcctgtttgccatgaagaacagctggccgtgttggtttaaaagccagaatttttatttgtttggagttttgcctcttcatttttagcatttctctctcatctctttctgcctttgagatagctgttcacagtgccacattttctgtgtctgtgaaaaaacgagccccttaacctccagtacacaccatagacatactcacccccttctaaaatatttattcttttagcagccctggctggtttccattgtgtttatttaatctttcaagaattttcttataaaagactggacaatcaatgcctttttactgattaaggtgaaaagttgtacatggtttttcaaatatttgtgcaaatgagagaatgtatgagtctttgcatgcatgcagatattatacctaatgttagactatagctgtaggcagattatctatttacctgtctttctctccttttggaatgctaactcttaaagcacagagaatattagtagttgagtacttaccaagtagcaggctctgggctctagattttggggacacccctgccatcgtggaggttacagtcttctcattacaactctgacccagtcattctacttctttgaagattatcctgtatgcaagctttacttagaattgcagaaagaatgagacatccttagtggtaaacattaatgaaatctacgaatagatactctcaacaacaatgcatatgcatatctgttgacatggaaagacagtcgtgttgtattaactggaaaacagcatgatataaaacaacacagaaaggatgatcccattttatgtacctataaggaaatattgtaggatatatttctggttacattagttatttctggttgctagagtttaaggacaattggggttttttgggtagtgaacatgtgatttatatttaatcaatatataaagaaatagagcaagaaaaaaacaccactgccatgattattcagataggcagacttttttcattcattcaaccactatatatggagtgcagctatatgccaagcacaaggcagagaacacaacatgctacagaagtccatgcctttagagcattctagaacacaatttacattaaaatgctactaggtaacagaaggagcagcagtgtatgtggattagagtcacctcaggatttccatcgtttctcagaacacactgttttgtttgtgggtggaataaaggaggctgccatgttcagtgtacataaagaaagcaggaggttttctcaaagagcaggcattggtacaacatgtcatttaatagttaagaggtgggggaaggtagcctaatgggttatgccagccacttatctttaggatagtctggataaaatataaagtactatttctcatgtcctctgcttatgctgggtccccatacaccatctgaactaatggactttttggcatcatctccttaaatgcatcatagggaatgaatttctccaccaagaagccccattatggctttgtcagcctaggttttgatttagcgatagcaatatgtgccttccagacataggatggcaatgagggagggcctctgctggtccttaagtgcagggagccccccttcttagagattaatcatcattgtgacagatgtgcttttgctgaaacttggtccagagagcagcagataaagatttggatgatgtctccttccttctttcttggccaaaggaagccagcccagtgctgggctttcaagaatccagttgtttagaaaggagggaggtaataaagcagaaaaagatgttttatttttagaaattaatgtgcagctttctgatctcccaatccagttcaggttctttcaacttcattatctgttgagaactattagcctaagaaatgatgtgactgtggttctctaccttggctgtgtgttagaatcatgctagaaactcttaaaaatctaggccacatcctagacaattaaatcagaaactctgggggaggggtctaggcagcagtgttttaaagctgccaggtgattccagtgtgctgctagaactgagaacttccacaatatggttataccagctacacaaggcagagagtttttaccttgaaaaaattaaaaaacagcagtagtgtaaaaatattatcctcttattaaaagaagaaacatgtgacagagtgaattcatttagatgtcttgtttggtttgattttaaattaccacacttaaggttgaaagccttatctgttgttccccattctcatggcctgatcactgtgaaattctgggaccttagaagccttttgtattgactgctcgctcgctcgctctctctctctctctctctctctctctctctctgtgtgtgtgtgtgtgtgtgtgtgtgtgtgtgtgtgtgtgtatttttcttttacttcttgtttggccaagaaactgtatgtgttaatagcttgtttgtttttcgtcttttgttttggctaaattgcttttcaagaaactgcctgactccttgtttaattaacttccatatcctgcatatgtggctcatttcacagtccctccatcccttagtggttttccagtccaccacgaagatttgtatgaagaaaatagccacctcatctatttatactattttatcttgatgtttttcattgtttctctgaagcacattatttctgatcttgaaatgtaatgttttaaaatatatttttataggaatttatttttctcctctgaattgcctttgttgttattcctttggattttgaactcacttaactctgtgctggaaagtttctgctgatttttgtcttcttgatctctctgtttctttaaattctaaattattttgcatttttccttactgttgaattgcaacacttagtctctctatcttgtcacaatttatggagaatgatagcagaatccatctcaatagtatagcaactaaacatgtatatcatcgtttcctagctgacagcctgcatggagatgcatcctttaaaaaggggatgaggatgagaaaggtactgtgccatatagtgttgggcatacaaccaagacggcagtagacacaatttgttagtgatgtccagttactagtattgctgagtttatttgtgacctacttttttaccttttgtattccctgtgcatacgtgtagcattaaaacagtgttctgttgccaacatctccaaacattagaaacataagtaactgtttttttcagtttccctgggctccacagaatgtagagtgggcacatctgcacaaagcacagggcacagcttgcccttgaacgcttcacagcctctgtcgttgccactgttatccgcttgtgtactcatcctagcctctgggcagacctgcagaggcacggacacacgggcatccagcttattccttcccttttttcacctccccatttagcttgtcttctttacccactttccacagtcctcttaggtaagaggccattcatttcgttaataaggatgtttgtttatttgtgtttcgaaagtacatgctatgttccaagcactttgctagctgctaggatgcaattgactacaagacagatgtgttttctgccgccctaatacctgtaatctggtcgggcagacatatgaataaacaggagtttacagtggagtgtggtcagtgctgtgatggagttagtgcagaggttctgggagaccatggcagggcacccagccttgtctcccgagtcaaagaaggatgtccagaggaagtggcacctcaactgagatcagagggatagaggtgggagagaacctgccacttttgaggaagtaaaagatgtatgttatagctaaaggataatggggaacaagaacggtaatgagcctggaaagatggggggcttatcttggaaaggcatggaaagcctttagggtttgaagcaaaggattggcatgctctgatttgctttttagaaggaccattgtgactgcagtgtggagaatggattggagagggaaagcataaatgaaaggtaacagtgtttgtagacatgacccagtgagagctattggtggcctggcctcgaagaggagatgggatggagctagcaaagatagggattcaggaaatatttaacccatgccttctgtctcagggcaggagtgattttcaacccttgaaaatgagggcttgtcctgcctgtctgccatttggagtcttcatctatgttgtacatcatgttgaaaagatgtgtattagcttcctactaatcaaagcatgtttgtggatatggacaccattacaggtttctcatgcttcccttggctcccagacactgggctaaagtgttggattggttgtgcagtatccatacttgtcaactagctatttgtcatttattttgcaccctagaggccaaaaatgttagagcagaatgattccttaagttttatcccatccaacacccatgtttagcaatgaagacatggggattcaaagaagggaagtgatttgcctggactcccacagagaattgggactggaacccagatgtttcagctcccagttatgtgattctttgggccagacaatggcctctctggccaatttagctacaagagcatgtcactttgccagttttacttttcccactccttttcagcagcagtgagttagtctaaaatgtggcagttaaataaatcaaggctgattttgggtgcacccttcctttaaggcaatgggcctctccagaaggaacagtgtgaacattgtcttccagctctacctctgctccccgcccccccgctttgttttctttgtctctgacagcagtggactcagaacctaaattcccccttcttaagccacttggtgagtggcagggagcagtaggactctgagaggttctgggggttttattgtgatgggagatagtcgtcctgcacttctgtagattacaggccagcaggtggaagcctgggctgtggaatcagattgggtttgagtcccaggtctgcttcttggccactgggcatgcaaggccttcattttctcatcagtgaaataggagcagtcatacttagttgacccttgaacagccacaggtgtgaactgtgctggtccacttatatgtggattttcttcagccaaacgtggattgaaaatgcagtatttgcaggatgcaaaacctacttataaggaaggttgactttctgtaccctcaggttctgcagggccgactacgggacttgagtatacacagattttgatgcatggggggagacgaactaatctcccacaggcagtgggacaaccacaattagacttcagattttaaaagataatatattttttaaaaaccagtgcagcgcctggcccatagttgatggtaactatgcttaaattagattattattcgctgtccttttactacagtttcccaaaccatagatttaaccccccacacagctgtctaccatcagttgccctggtatcagttttttaatgaaatttcaggagtgtgggattctttgtctctgcccttctaataggtgggaactcttacctctctcatccacttagccccccaaaaaagacagttaaacttgaaagctaccagactgtgaaaaagtaaataagaacccctggccagggagagggcttcagccttagatgtttacaagggcctgaagcagagaaagagatagaaaatatgtaaaagcaaattttacctgcttggaaagtagcttaattttttttttttcttttaaactaattctgtagtcggccttgtgctctgtagagctggatgaatggttaaaaagaaagggggaaaagccagaagaaattaattctgtggcacagagctgtgaattcttccttgatgcaggatctgaggttgaaggaggttaaatatgtgagggccagaaggaagtatcatgtaatgaatgataaatctctagctgctcctcagcagggcaaaacatgggcttagcaaatgggaaaaaaaaaaaaaaaaagggaagtagcaggtggagataatttaaatagcacagggacccctgcttaccaatccctccacagagttttgccctggagtaagcatgacatcagggtgcttgctgcttcctccagtggcccgagctctgtgtgcctttgttgaacaaggttttcgtggagctgaggtgactctcatgaacagagaatacctgtccttcatacagagaagcacccaaatgcaaacatctactttttctggtgttcaaccaggtaaacctctgtttagcaagaaacatcatccccagagtggggactgtcttgtcctttcagaagctagtaccctaagcaagactcataaggaaggtcgggcctccctaggtctctgtttcttctgaacagtgatgagctaggtgcagagagagttaaaggtcactatgcagctgacaagtgtgaccagttcccagtaaattccacttggctggggtttcagaggtgagcaaggcaggctttttactcattacacaagaatctagacatccctttaattgggtggcattctgggtgctaaaaggaaggggctttgagaggcaaagatgatgggatatcataaatttttttgtttcctttttaatatagcgcagctcctatacttaagatttaactttgaaatgtagcatagctaagatctggtccaaaaagatttctgatatctccatgaatcctagttagggattgataggaaaaaaaaaatcttgtgccacagcttcatgctatttttaggaacctttctgaaaccagtggcagcccaagttagagcccagcattaagtccacctcatgcacatcatacagttgcagcttatggtaaaagctttctgcaaagcttttctgctcctgggttaaggccttccagcatcagtcacatgtaattaacagctacattgtgtgcttactttttgctagatgtttcataaacattatctcatataaacctcacaataactaggtattattrtcccgtatccctgttttacagctgtggaaagtgaagtgaaggatttttgtcatacagccagtaagtgccagaactgacttgaacctagctctctgtcttgattcaggaactactgctctttccattggtggctcctggctaatcaatgtgatagtctttgaagaaaaaaaaaaaagagttactatcttcagagttttaaacttatctgggagagaatttaggacttttctttgtgagacagtcttgctctgttgcctaggctggagtgcagtggtgtgatcatggctcactgtagccttgaacttctgagctcaagtgattctcctttctcagcctcccaagtagctaggactccaggtgcatgccaccacacctggctaaatttttaatgtttattcatttatttattattttgtagagactgggttgcgctatattgcccaggctggtcttgaactcctggcctcaagcaatcctcccacctcagcctcccaaagcactgggattacagatgtgaaccactgctcccagcctaggacatttttattattcctctcgctgttaatccaacaaccctgtccacattcctgtaaattggctttgttcatcttttttacttccagacatgttaattttaaaaagaaggcatcttactatctttttaatggcttctgttttcttccaagttaaaccaaagagtcatttgtaatttgcctcagtaattggactgtgactttaaatggctgctagaattggccttttgttgactttactggagttaaaataattctctgttttcattagccaagagaaagacttgtgactcttgatgcttttcccactgcaggagcaaagcagtaaccccagtaagggagaagagaacttagatttgtgtaagtccactgtgtgttggacacttaaacatactttagatgtattatctcattcatctttctgactgcatgaaggtgctattgctgtccccattgtgtaggtgcagagagagttaaaggtcactgtgcagctggacatgtagtcgatctgggattcaaacccaggtctgtccagctcatgttatttctactgtatcacacttctcacctgtatatgttgaatggccagagtgaaggctgggctttatgggatacagaggaggtgactgtacaccaggggaaatcagtgtcacctttctgacgctccgtggcattaccctcattcagaactcattaccaaatacttcatgtaagtaacctcgaaagtcttatgagtacatcgagaactagttccaagtcacagaactgttcttgtggtgaaagtggttgaaaggctatagttcattttggttattggatggaaatgccctctctctctggttgattaacggagaagacttagtataccagccattgtttcttcgtatggaacgttgcttgttttgtcccattttctcatctgcaaaatgtgggtataatacctattacgtaagattattgtgagaattgagaagtgtgataatgtaggtaaaacattagcagagtatttggctcttacatagaggctcaaattgcattagtggcaggaggaaagtctgttttattcattgttgctccctcagcagccaggccattgcaaggcacatggtgcacattcagtaaatgttggtgagtcattgatttcttttctccctttgtacttattttttacagatatttgagcacctagccttgtgctggacaataggggacatggggtccttcacacaagaaacatttgtagcctcatgagatagatggtcatttgtgaaaataatctaaagaaaatgacccattgttgagtggtagatggtgacccttgaggctatagtgtgcaaagctgatttggaaatccctccagccagctctggggctgattgtggtgggggtgggggaatccttacttactacttttggccctgctgtcagaattggaccttgtactgtcattctaagctgggttgagcctgagcacgtcttgtcacctctgtgactgaaggctgatttaatatgtcatgaggcagtttggtttcaggaagtggtttgctggggcatgagcgatggatgttggaagttagaaaagagccagaaattaaaatgctgcctcagttgggtgattgaatccagtcttacctggtggggcaaccacttattgatttggaaagccttggtgaatccattttttgctactcacactggggaatggggaccagcagcatcagtatgacctgggagcatcttcagaatgctgaatctgagcctcctcgtcagacctgctgaatcagaatctgtattttaaagagatccccagatatttatgtgcagtgtgaaaagcaagctttggaaaagaaagggcaattctgtagactttaagcttaggaacaagagtatttttctggagtcatttgaatgtcagtcgttaagcagggctgccaattagggctgattttctcactgtttaatacttgccaagtatcttgagcagtggcttcccagactgagctgctaactgaataaaggtggcatgattgccgatgaaaataatagtacattcgagttttaaaatgtttttatatagatccttttctctgttcacagaacagtcttgtgagatcatctcatctctgctttacaggtaataaaactgaagcacagagaggttatgtgacatgcctagagtcacacagtaaaatcagtagcagttttgaactgaggtcttaaaattccaagaagttgggagcttgctttttttttccttttcaccatctaaattttccacattgagatatgagagaaatcctccatttctgccattgcatttgtgtaggtgcacaacagggaacgtgagacaattatagtagagaataatctggaccaggaatggcgttctgcaataatcacctcttgaacaataaacttggaaagtttcgtggttgtttctgattcagagcctggaagagcaagccatttccctcctcctacccttggtttactaatcattcacttcctcttctgtaaagcccaactcaaaggacccctgctttgtaaagccttccctctgggatgggattggggggcaggcagataattggttcctcattcatattttattcatacttctgttaacaaagctgatcacaccatcttaactgcacatcttattacccacatgcgcagacaaggctgtaagattcctgaggatctagaaagagtcttcttcaccattgtagccccattgtctggcatgtgttggtccttcatacatgttaagtgaatgaatgcgtgtatgcatgattcagactttgttttttgcctttcttttctttttccctatagtctgctctttatagatttttaatagcatccaaaagggtagtaggggcaggaagctaaagggtaggaaataaaactcaaattcttcagtttcgagttcagttctcagttcagctcctctccagcagcttttaggaaagcattttaaagaaagggaggctcacttggggcttgaggatggtctggtccctcacagtgaatagacaagcatcaggcgcagctgcagtttttacggaatacgtgcacattacctttcctcagtgtcccctcgtaagcagtgaaatgtaataaatggcgttttagggagccgaagagttgtcaagtttccacagtttggagaactttaacatatggcatcttgggatctaatgaaataaataattcatgcctggaaatataagcaagagtgaatctctctccttgctatgtgaatggggactttggttgcctttttcaaggtatgtatgaaacatatttattcagtccactcatttatgtccctttactttctcactcactcgtcaaacttatcagcctcctcttccccttccttttcccctcttcttttccctcctcccctcatctctcttctcaccgaaaccctgagggagataggaaggtaataagtattattgttttgtcagtgtctccatcacacaccttctgtttttctttcttgaggcatctcagagggaagtggcaggagatgactttcagcagacctttccccttagtgaggacagtaagtcccaaggacatgtggaggcaaggatgaggggcagatgaacaagcagctgtctggcctaggtcttacagaattatttttcctggaattaatatgcttagaatgtatactttagcaagtgtctatttctggctccagcatttttctttgggtgtcaaacctggttttatctctgagatttttcgacactaggagaatttgacattcacattctaagagtgttctgtaatgtttccatttacataccagttttcttcattttttggctggaggggtatgtgaatatatacaagaatctgagcagattcatttttagctgcagcagaggcaagcctcaggggaaaagtcaagataactggattcctgaaatggtataacttggcaactcgtcttttctgttccttagcctgtaaagcattatttggttttagaagaggagtagctcctacttgtgaaggtcttcattggaatggcacattgaatgcatgaacccttaaaatccttactccctttaacccaagccacatctcagtggctttaaagcatatcaaagcaaggaggggaaagtctgtgtgatacggtactaaaattgatcctgtagtaccaggcatgaggagaggaaggaggagtatcatcattatcctgttaaggatttgtcatgcctcagagcatctgcaaggaaatagtccacagataaagttcagcaagtgatttgcaattggtagaggtggtttggcattttgaaaagctttataaatgtgactgcagcctgagaagaatgaccaccactggaatgagggaaggctggaaggatttaaggggttctttatgaaatcaggcacacatccccatgtcgactaggctagactcaggcaccataatagccctggttcagggtcactcctctttccaggaaggtttggatcctacagttagaaaagaggaatcttggatctctaggtaagggttagagaaagtattctgggcatcccaagttagaatctggtgtctttgcttaacgagttctgaacatttcatgtgagggaatatgggctactgttgtaggccttgctgtttcacctgaaccatccctgcccttgaaggacttaaagttggaaggaatgtgaggaggcggagtagcacagttatatgacatctaatccaaagtagaatatgcgagccttaagagaagtgcagagggctgtgaggagtatgaagtggctggcaaatagattcagtattatatttcatttattcattctgcagatatttatggaccacccttttatgttgctattgctgtgctagtattggagatacaaagatgaatatgacacctctcgggccgttgccaactgtcgagtaccaggaagagcgcttagataaatgaccatgtacaatggggtacgtgcaattataggtccactgttatttgctgttctgaattccaaatgttaagagttttgacatgaaattttgtttcatgaggcttttagaagctaaactagaaacgtactggatatttaaaaactgtgttaccagaatctgataatggagttctacactagtccctgtggggtatgttgtataataaacaataagtatactgtaatttctttctgaaatctacaaaagtatgaattctaaaacagccagccccagctaaaggattgtggatacaagtaagatacttcaggtgatttgagagtttacctggctgtatgggctaccctgggaatataaccactctttataacatcctttcttcgagaatggtatgtgctaagttataaacagctgacttagggccatcattttaaagtatgaagccttccagtcttcgcctccccagtcttttccattcttaaagtttggaccagtctgcaaggtagctgcctccctaaggatttggggtattctctaaaatttgaatatatgatattcttgtgccctttgaatacgctgtttaaaaataaattttaaagaatattctcatgtaaaagtaacacacatactttggaaaatacaaaacataggaagaaggaaaaa

SEQ ID NO: 12455 - DNA, 14248 bp, Homo sapiens
aaagtgccttccaggtagagggtcccagggaataacctatagtgggactgttactaatatgcaaaaggaatagcaaggaagtcatggcgatgagtagaataaacaacgagttcaagagtaataggaaacaagatcaaggaaatggaacaaggatcctggccattggcgggttttgagcagaggggtaacatgatacaacttttctttttcttttaacttttattttaggttcaggggtacatgtgcaggtttgttatacaggtaaactcatatcacggagtttggtgtacaaattatttcatcaccccagtgcatgatgtaactttaactgatacattctagctgctgtgttcaggatagactaacatagcaattcagtctatgttcaataagatgcaggggtaggaacaaggaaaccaattaggaggctgttggaataatccagatgataggtggtggtggctcagaccgggctggccacagtggcagtagtgagaaatagccagattatttcattaaaataactgggttttcatccatgatgactccctcaggtgtcagctatgacttttgtgttcttctagcctactgagcctgcttctgtcatgacatttatcacactagttgatttactctgttttcccaggctaaacaataaacttcttgaggactaggatactttggctttgtctctgtatcatactccttagcacagggctggtacaactcattgaataaatgttatttacatgaaagaatgaattaataaattaatggtgagtaatgattaatgatttgtagttactttgtgtttgaaataacggtgttcttattggacagagagctgtgaaatacctaattcttgcacgttaccacctttctccccaagatgcccaagggagacatagggtcagaggacaaagaaaggcaaagccgtactttgttgttattgtgggccttgctctctaaccgcaatacagaactccagtgagttaggttggcccacatcaaggactcaaagttcttttctattaaaggtagaattaagtagccttgatgcaaaacaaattattagttgagtcacatgaaattgatagtttgactgtttttgacctacagatatggcagatacatatggttcagtctaatcaaaagccttacctgagtctgtgatctcctggctccatatctaccaggactttagagaaagtgggggaagggggcattctcccattacaagcttatttccccttctaattagtgtcctgaaatctgactaatcccaaccagtagtagagtgggggagatagatgatagaatcccaatttgaactaggttaagtagtaaataaataaataggaaattacagctacagttcagagaaaacaacttcagcaaggacagtaatgtgtctgggcatcaagaaccatccagctcaaagttaccagctagtttctctgtctctcatctatgcttttctttgaaatttgctttattatttttttttctcactgaacaatgtggcaggaaatgtggccacagacaaaattagagttttaaatctcagaattttagctgcttgagagagtctggctcaaattactaggtaccaaatccaaaaatcctaggaaaggaactcattgggccaaatgtccatccctgaaccagttaactgcagccagtcatggggaggcataagaacttgccagctccatcatgggctgaatgtgtttctagaaaatagtagggcatgttgggctgacagtctcatacataaccactatagggtaaagaagcattgggggcaaagcttcctcaaaaggccagcacttagtcttgaaccaaataaaagcaattctgaaacaatgaattcttattctgcattgtcattggacttactcaacactttgttgtcggctatcagaacatttctgatacttcagaaacccacaggaataattaaagtcataacatggattttcataaaggaaatccaaaagaaaaaagtaacctctactttgtaaagttgtattctgattagtaaagccactagcctgtatggcaccattgcgcagattccaaaaagtttcccttgaatgtaagctggattttagctcctattcaccctttcagtcagttgccactgcacagatgtatatggtggtctaagtgttagctgtttgaaataagcggctctgggaattgttaaattattttttttaaatcaagcatcaagaactgtgaagagtctgagatgttaccctacttacaagctaactagttaatttgcaacaatttcatgaatgctggtagaagacacaagactcctggtcagagacaaaggacagtttgttaaagcaatagaagtagccagagtagcatcatttgcatcacttctctgagccccacatgctgaaggctaggtgaagcctgcacatgcattgtgttgctttacaggagaggaacctgatcagagtaaacagacaacctacagaatgggagaaaaattttgcaatcaatccatctgacaaaggtctaatacccagaatctacaaggaacttaagcaaatttgcaagaaaaaaaatcaaacaaccccatcaaaaagtgggcaaaggatatgaacagatacttctcaaaagaagacatttatgtggccaataaacatgaaaaaaagctcatcatcactggtcattagagaaatgcaaatcaaaaccacaatgagataccatctcacaccagttagaatggggatcattaaaaagtcaggaaacaacagatgctggagaggatgtggagaaataggaacacttttacactgttggtgggagtgtaaattagttcaaccattgtggaagacagtgcggcaattcctcaaggatccagaaccagaaataccatttgacccagcaatcccattactgggtatatacccaaaggattataaatcattctactataaagacatatgtgcacgtatgtttattgcagcactatttacaataacaaagacttggaagtaacccaaatgtccatcaatgatagactggataaagaaaatgtggcacacatacaccatggaatactatgcagccataaaaaaggatgagttcatgtactttgcatggacatggataaagctggaaaccatcattctcagtaaactaacaggaatagaaaaccaaacaccgcatgttctcactcataaatgggagctgaagaatgagaacacatggacacagggaggggaacatcacacaccagggcctgttgggggttgggggagtaggggagggctagcattaggagaaatacctaatatagatgacagggtgattggtgtagcaaaaccaccttggcacgtgtatacctatgtaacaaacctgcacattctgcacatgtatcccagaacttaaagtattttaaaaaaaaaaagattctaggcttttataaggggactgttagcaaatctattcagcctttgccccagagggagattttgtctttctaatcctggacaatgaacaaacaaatctatcacctgccccagagggaggcattacctctgtcttccaaaggctgtttgctgtggaaacatctttgaaaagagcttcagaagcaaagttgctaatgtttctgctcagaagacgtgagacctgtagagccctttttggcaccagggacccgttttgtggaagacagtttttccatggaccgttgggaatagggggatggttctgggatgaaactgttccacctcagattatcaggcaggcgttagatgctcataaggggcgtgctgcctagatccctcgcatgcgcagttcacaatagggtttgcactcctatgaggatctaatgccactgctgatctgacgggaggcagagctcaggcggtaatgcttgctctcatcagccactcacctcctgctgtgcggccggattcctgacaacccatggcctggtacaggtccatagcccagggactggggaccctctgctgtagagaattgtttccaacaacaagggaagggaagtggaatggcaaggatctaacatttgtgcccttagatcgggggtcagcaaactttttttgtaaaggtaccagatagtaaatgttttaggtattacaactactcacctctgccattgtagagtaaaaaagcagtcaaggacagtatgtaaatgaaagaatatggttgtgttccagtgatactttttaaaaataggcagcaggccatatttggcttgtgggttatagtttgcaacctctgccctacatgtattgtgtttagacttattaaatcttccctttttcttaaaccctcattttcacagcccaaatctagatcactttataattatgttttatctttttttgcatctaataaaatcattgttgtctataaaatatgaagtcaagaacgccatttgcaatgttgagcatcttagaatataagcagccacagatctcatatgtatttctggaatataggtatctggtctgatgtacaaaatattgaactaaagtctaaatatatgttaatattaatataacactggattaaatgtattatatgtggaagtagtcgaagtatttatggaacccactcggtttattgaacaaaatatcacctatgtattttatctagatgctggagaagtttggcgtaatatgacttgtataaacttaggaaacaaggttaaaaaagtaatcaaacattttctttttctttgtggtttttttttttttttttttgagacagagccttgcttcatcacccagacttgaggacagtggcactatctcaggtcactgcaacctccacttcctgggttcaagtagtcctcccacctcagcctcccaagtatctggaattacaggtgcatgccaccacgcccagctaatttttccatttttagtagagatggggtttcaccatgttggccaggctggcctcagactcctgacctcaagtgatccacccatcttggcctcccaaagtgctgggattacaggcatgagccaccacacctggctatgttttcatttactacctttctgtagttaaacaagtatatattattaccacgaagtgtcatttatgatcctgtttattgtgaaagagtgcatagacctctgggaattatcacagataacctttggaggttgtaagggagggcctttttagacggtgaattcattagagaatgctttttaccttgaacttggttgaatgtggaaagaatgagtggagagaattatactgtttttctttctttattcatcccttaacatattttttgataattataataaagctgtagaattttgagacaaagttgaaaacacaaaataaatgtttggaccatgcatcctaggattagactgagagaaggaatcagtgagtctgccaaggcttgatggctcttaaatgactaaaggcatacttctaaccaccttgtatgatatctacagtactgattcctggccgctgtgaaccagacctttgttctgttctgctctagtcccactcctctacccttgcctttctccaactttcaaatagtcttcccttttacattacagtttcagctttctttccccgatattatatgtaggccaactttttatgaatttccacagagataaagctggctacatcaacatttatttaatgatttgataacaaatatgtttgtggaacaatgtagaataaaagtaagacctgtcactgtctctaatatgcttatcattaaggaaataaacatgtaacactgaaaaatataattagccagataagagcttatatttaaggttgattatcatagccttagtagcatgggaatttatggcaaaaaagaaaacttttgctgagtataaatctataaatataaaatatatagctctggagtcatcccagtacagccttggtgccatgtgcatgtcggagagtcccagcccaccttgctctctagtacttgtagcctttttctttcgagatgcctgagaaagtgcacgtggagcggaggagctggaaacttgcctttcaggcagatattgcccaactcatgtctctcgtcatcaataccttctattctaacaaggagattttccttcaggggttgatctaatgtttctgatgcattggacaagatttcctgtaagagcctgacaaacccttccaagttggacaatggtaaagagctggaagttaacatcatccccaacccatggtaatggttcccaaattaggagatcagccttggtcatgtcaatgcctgtgtctaccaaagtcagggtgtattccctggtactaaaggatttatggaggctcttcaggctagtgtagatatctccatgattgggcagtttggtgctgcctttttttctgcctaccttgtggcagagaaagtagttgtgatcacaaagcacaacaatgatgaagagtatgcctgggagtctctgctgggggttccttcactgtatgtgctgaccatggagagcccattggcaggggtaccaaagtgaccctccaccttaaagaagaccagacagagtacttagaagagaggaaggtcaaagaagtagtgaagagcacttacagttcatagcctatcccattaccctttctttggagaaggaaagagaggagaaaatcagtgatgataggcagaggaagagaaaggtgagaaagaagaggaagataggccaggcacaatggctcatgcctgtaatcccaggactttgggaggctgaggtggcagatcgattgaactcaggagtttgagaccagcctagccaacatggtgaaaccccaactctttaaaagatacaaaaaattaggcggtcatggtggtgygcaccttaggtcccagctacttgtggggctgaagtgggaggatccaccaggaggtggaggttgcagtgagctcatatcacaccaccgcactccagcctggacgacagagtgttacaccatctcaaaacaaacaaaaaaaggcagatagagatgatgagaaaaagtccaagattgaagaagatgtgggtgggttcagatgaagaggaggacaatggtaaggataagaaaaagaaaaccaacaagatcaaggagaaatcattgattgggaagaactaaacaagatcaagaacatttggatcagaaactctgatgacattcacccaggaggagtatagagaattctacaagagcttcaccagtgactaggaagaccatttggcagtcaagcacttctctgtagaaggttggttggaattcagagcattgctgttcatcccttgtttggctccctttgacttctttgagaatgagaagaaaaaaagaacaacaaactctgtgtccatcatgtgttcatcatggacagccatgatgatataagagtatctcaactttaatccttggtgtggttgacttgggatctgcccctgaacatctctcgagaaatgctccaacagagcagaatcttaacagtcattcacagaaacattgttaagaagtgccttgagctgttctctgaggtggcagaagacaaggagaattgcaagaaattcaatgaggccttatctaaaaatctaaagcttgggccagttgtggtatctcacctctgtaatctcagcactttgggaggccaaggcaggaggattgctggaagccaggagtttgataccagcctgggctgcaaagcaagacaccatcacaacaaaaaataaaaaaaattaacccagcatggtggtacacacctgtagtccaagctacctgaggcaagaggatcacttgagcccacgagttccaggctgcagtgagctatgattgcaccactgcactccagcctggatgacagagtgaaacccctatctataaaaaaaaaataaataaaattttagaatttcaaaaattaaaatctaaagcttggaatccacaaagactccactagccagtgacgcatgtcctagctgctgcagtatcacacttcccagtctggagatgagatgacatctgtgtcaaaatatgtctcctgcatgaaagaggcacagaaatccatctatagcatcactggtgagagcaaagagcaggtggccagctctgtgtttgtggagcaagtgcagaagtggggctttgaattagtatatacagccaagcccactgatgagtactgcgtgcagcagctcaaggagtttgatgggaaaagcctggtctcagttaccaaggagagtctgcagctgcctgagtgagctgagatcgcaccactgcactccagcctggcgacagagcgagactctgtctcaaaaaaaaagaaaagaaagaaaggaaacagaagagttttgaaaatagtttttattcaaggaaaagaacctaaccttagaagtgaaagtgctttgaaaacttaaaatactagattgttatcatcatcagaaggcttaaatagaatgaataggccagtagccctattattttatataaccaaaattttaaatttagctaattgtttattatattttacaaataaactatcccataaatttttatgattattattttattattattattttttttttgagacagggtcttgctctgtcacccaggcgggagtgcagtgacctaatcatggctcactgcagcctcaacttcctgagctcaggcaatcctcccacctcagcctcctgagtagctgggactacaggcgcaatgcaccacacccagctaattttttacattttctctagagacaggatctcaccatgttgcccaggctggttctcaaactcctgggctcaagtgatcctcctacctcggcctctcgaagtgctgagattagaggtgatgatttttttttttttttgagacggagttttgctcttgttgcccaggctggagtgcaatggcgcgatctcagcccacagcaacctccgcctcccaggttcaagccattctcctgcctcagcctccagagtagctggaattacaggcatgcgccaccatacccggttaattttgtatttttagtagagacagggtttctccatgttgatcaggctggtctcagactccggacctcaggtgatccacccacctcggcctcccaaagtgttggaattacaggcgtgagccaccgcgcctggccagaggtgatgattattttaaattgcccacattttttgttgcacttttagagaaagaatactatgttttgatgatgcttagaaggcatgatgtagcattttgtatatatgatatttaactcttggatttttgtggaactttaaatcattactataattgctacgtttgtaatgtcatcaggtgtacacggcatagtgaaaatgtttaataggttgatatatactctcagaactataatagagaatctagttgggagacaacacttgtcaggaaaaaatcttaatcaagcctgtttaattacaaattgattttttttttaatgcttgcccatgtcaggtcaagcctagtatgcaatactgatattttgaatggaaagaaagctatcacatggttttagaatggacagtgtttcattatttaatatgctgcctatgatttcaatgaaaatgagattgagggaagaatttaattaagagtctaatgttcaatagaagggtaaaaggtgatttaccaagaaaatattcggagggggaaataaggaaatatttgttttaccaaataattgaattatattgtaggtctacaaaaaataaaacaatatgggactggtttaacaggacaatcaaggcccagaaatatctcctagtacataaataattagaatttttgcatttaaaatcattgagaaaagactattcattagctcatgtagggacaattagttcagtatctggagaaaattaaatatggagtcaatatatcaaaatcaattccatatgaattaaaatttgaaaccatcaaaggtctggaagaaaatataagtgaatagttaacttgatctcaaagtagagatcattaaggcaaaggaagaagccaccttatcctgggggccatggtcttcagtttacagtaaaagaaaataaaaacaaaaaaacagttcaaagagtcaggattggaaatgaaggtccagacgttcattttggtagttggctaaaacacccaagaaaatcaattgacaaactgttaaaaccaataagaaagttagcaagatggccaaatatagaggatctagggaaaaaaactaacaaaaaagtttataaatccctgccccccagcaaaaaaaaaaaaaatgagtatgtttgtaatattaatatatgcttggaggttacagaaaaatttcttttttttttcttttcttttctttttttttttttttgagacggagtctcgctctgtcgcccaggctggagtgcagtggcgcgatctcggctcactgcaagctccgcctcctgggttcacgccattctcctgcctcagcctcccaagtagctgggactacaggcgcccgccaccatgcctggctaattttttctattttgtttagtagagacggagtttcaccgtgttagcgaggatggtctggatctcctgacctcgtgatctccccgtctcggcctcccaaagtgctgggattacaggcgtgagccaccgcgcccagccgcttacagaaaaattttcatacagttttgagggcatttacttctttgtatcatttctgactaatatctatgtgtgtgatatcctactaatgtttgttattgtagttcatataatactgtaggggaaccaagaattaaatgtcataaatgtttgcatattttctaaaagaataattatattcactaactcatctttttttctttttgccgtgtgtaataggtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaataggtaaatattaattctcatttaaaaccttaactatatttgatcactaaatatgttcattttaaaagtaaagtagaatactttttagtaaaatagtaaagtagaatatgattgtattgacaattagcatattcagtttatatttgctttttcttgttaaactgaatttatcatataagataaatacatttctttgctcttagtgaatcaggtcccagtaatagtaataccagtagtgatggaaggctaggtctgcagagtcaagattgccatcatgttttacttacctgtgtcacctttccccatctctcctcctggtcagcttcattccctgcataattttaagtggtttattgtgtattaaaagcaagaaaatcgctctgcatttctgaatacaatacttctcgtatctcgagatcctttcctgtttcccttcacttttcaatttatgggaaagtgaagggagtgaagactgagaggatatagaccaagcttgaccaacctggctcaggccagctttgaatgcagcctaacacaaattcataaagtttcttaaaacattatgagatttttttgcgattattttttctttagctcatcagctatcattagggttagtgtattttatgtgtggcccaagacaattcttcttccaatgtggcccagggaagccaaaagattgcacacccccgatgtagactagtctgcttatcttcctctccatgtatagaatatacagtagcctagaggatatcactggtatttatccacatccaatttttacatgttttcaatctgttgccaccatttaaaaatgaagatgcttttacattttaaaaaatgagaaatctcacttttcttggagcagagcgtaaaatatggcagtactggccctttatccccacatgcagcaaccaatgagtgggttgctgagcagcggctgcccccagctttggctcgcactttccaggttgcttctgtgcccaccgcatcctgttgtctctccaacaaagtgtcagtggccatttttcatcccctttgcattttttaagtattttgctaaaaatataccctttaaacattaaatgtaacaattgtgtgtcttactttgaaatttgaaatagtgtaatatttagaatgtctatctctttctttttggtttttgtaagtggagataaccctaaggtttagttgagagaagcttcaggcaaaacctcaattaaaagtaataaaaggtttatgtcattgtatcttccaaatgttataaccagaatgctccagagagctcctttttataatacttaagataaacaatgccttttgaccaggatcaagtaaaattaggtaattgtaccttctttactcattgtttcacataactcttccatttttctttatctgagctctttggcattgctgaattttctcctctggttttcatgaatctttcggtaaagaaagtcattttgtgtgtgtgttatatttttacacaaaggaataaaataatttttgataaagcctggtaaagttttataagcaactagagcaaagaaagtggagttaaagtaagctgatttcaaaatccacttaatttttaaaaatattttgataattaagacactatttaaagaacacaaagtatcctaatttttattatataatgtgtgacattaatatattgccaaggaattattgtgttatttttgttgcttgtaattcaaccttttttacctagttaaaaaaaattagtttaggaagtgtcaagcagctgatacatgaattgtctgaaggttgagaatgttatccaaaggttaaagcagtagaacagtattaatttttctttgagctggcataatgagttgatgagttgacctttagttggcctatgtagaatagaagaaataaatataataaatttcatagtatgactttaacagagaaataaaatatgaatgtttaccattgcctcagtattggttgtaggcttttctttgtcattcttagacaaatttttgtgactgtatgtttcattcatttggttggcatttattgaatgccttcaagatacagagttcttttgtctgcagtatgtacttgtatgtaacaccacctggatgacactattatcaatagattgtagggttaaggaatataatatgtctaaattagtcctccaaaaacattttaagaatgcaacagaaaacaaatactgtattttagtgttttagtaaaataagggaggtaagctatttgttttatttatttttaagaacgtatacacattaaggagtccgcagttttcttatttgccaccaatctggttttgtctgtaatgtgcaatgacttttttttctggatttcactctgtgtttggcatgaaactgtattccttacaagaatattaggaataatattccattttccccaaagagacccagtatataagagggttttttttaagacacaaagaataggttaagctctctttactatattcagtggctttatgttagtggttgacaaatttgagttcagctaagattttaccagttactgtacaactgttacatcaaagtaaatggcatcctatatgatttcatgtgttgatattaatgttgtggcgtaacagagccagtgtttttcagccacttctacatagccatctcaaatatataggagcaaatctagaaatggtgtccaaacagagacacctaattgggtaagctttcccagtttagtcggctccaagtattataaaaatccattatttgaatgagtttatgctgatcattttgctcctgaagcatccatataataaaacatgccattgatcatggactgtcccccagaattagtatggcactaagctcacagttaattatcttaagactgaagacagtatcaaacagtgtcaaagagtgctatcaacaaggcatcttgagagctgtcactttgtcaaatgacatgcaaagatacatgatgaagggagatctaaatcatgaaagccatcaagttttggagatgacggaatttgctactaatgtgtcagataaaaacaagaccaaaccccaaaatagttatggcacagaaggcattaagaattcactcaagaatagcctggagcagcgtgtgactgacaaagctctaaactgttga

SEQ ID NO: 12456 - DNA, 19533 bp, Homo sapiens
ggttctccatcttacagagagcatatgatgggacttctcagctcccataattacattagccaattcccatagtaaatcccctcttgtctatctatatatattctattggttctatttctccaggaaactctaacttatcaaacagtaattgcacttctaaaactccatcctacagaaatggttaaccatgtagacaaagatatatacataaggatgttcactgaatcactagttataacagcaaaactttaggaaacaaacaaaatatctatcaatagaagaatggttacataaattacattacatctctaccatgaaatactacacaaaagtgttttcactcaagagagcagaagagtgacttggtctgttgcattttaaaatgatccctctaatatattgagggtggtctgtcataggatgcagaaggagcaatggcagatagagaagatctgttaagatgctattatagcaacgcagacaaggtattaatggtagtgagaagtgatctaactgtgtgtgtgtgtgtgtgtgtgtatacatacacacaaatatagacatacacatacacaaatttgctgactgactagatgagaaatatgagaaaaagaaaggaattaatgatggcccagagtttctggcctgagctggaacaatggaatatttctatctaacagatgaaaaaactaaaccacttagaggttaaaaaacctgtccaaagtcacaccaataaaatggtagagtcactagaattcaggtccatctgaccgtaactcttaatcgctgtgctacaatgatttatttgtctaaggaacttctgcatctgttactgtgcccagtattagtgcgtattttcttatttaacatgaactaataaaaaatactatgagctagatcatttattagccaaataaaagtattttttagctatatgcttaataattataagatttttaagggacttttagtcagcaaatgacttattattgaatggcattaattgtcagtgaagatcattactgccctccaggatgacaagcttcataaaatctcaacacccattacacccaacctccaatacaggagagaagacaagcaaatttgttatctgtgctaatatgttaaacagaaaactaaaatgagatacataagaaatacaaaaatatgtatgcatattaaacttctatgtaatctacaccacacttgaatgctcttctccaacttgagtcagaagaccatgtatggtactcagaatggattccaaatctaaattgaagagacagtgaagcaaaactcttctaatcattttagatatttccattttatttgtgtaggcctacataccttcttatttgggtgcactaattatcttttaggaatctctgacagtgtattaatattagataaacctcagggaggtaggaaaattatataataaaagacagcaggtgtgatgcatcacacctgtaatcccagcactttgggaagccaaggcaggaggatcacttgagccaagggtttgagaccagcctcggcaacaaagtgagacagttagccaggcattggtggtgtgcacctgtagtcccagctacttgggagactgaggcaggagaaccgcttgaatctgggaggtggaggtggtggtgagctgaggtcgcaccactgcactcccacctgggcaacagagcaagactctgtctcagaaaaaaaggaaatacagtcgggcttctgtatccacgggttttgcacctgcagattcaaccaactgggatggaagataatagcatttgtaggatgtggaacccacagatacagacggctgaccttttgtatgtgtgtataggacgttttcctatcttcagggcagactgccgaacttgaggagcatccatgaattttggtgtccgtggacattttgggaccaattccctgtggatatggcaggacaactgtagagatgaatttaacagccagttcaaatgcctttagtcaaaagcatgcccaagtttactcagcagatgaaaaaaatctgtaacataaactacactattccgatatgaagaagagatgtaacagtatattggaaatgagctttttgcctagaaaaggatattcaaactcatgtctttgttactaaaaatagtttgggaactcaagctttatagttaacttcaaacagattctgaaaacatatcttaagcgtttgaaattagaggaataacatctatttttccactatcttcaaacactcaactataatagacactagacacttgaacatgtgattttaaaaacaatcatgacaaatttcctgcattatgatttaggaagtttagccttaccatctcttacctgttaagacaaaaaaaagaaaaaaacaaaacaacaacaacaaaaaaaacacctaccactaccaaaaacaatgtaaagattatttcctttcccgtccagcaggtaacaaattagtagttctgatgggctatggacccagaagtttatattttaaggacctatacctggtgatgacaagtatgcaggaaagagggtctgaatttccacgatcaatgaaatgaaattggttctgagtgttacaatgcagagtattatagtcaacctcattttaactgaatgctataaattcattcaattaaatgttagaagcttggtatgagaggaaaaaaaagggctttagagtcagagaaatgggttcaaatcaaataccctagtttattatgtaaccttttacaagtcaacttctctgagccttggtcttttcaccaataaaatgaggataatactgcctctaacaccatttttataaatattagataaagaagataaattgagcatgtggcacaatgactatcacaaagcaatgctcagtcaccatttgttttcttcctaccccctctatactaaatgtcagaatctcgcctttagtcaatgaccttcactcagtagtgtgctggttaacatttaataactagctgtccagagggaagaaagcccagtttatagcactggtttgtagcactggcttgtttctgtggtgtaaatactcctaccatggccgatcccaagcatgaagtcactgaatgcagagatgtaaagagatgtgcagtagcacaccatttttgtctatcccatctgttttattatctctactttgttttattttcttcataacacttttacctttttaaattatcttgtttaattatttagatatttgtcatctgtttcctctgacaagaaaaagcatcaggaaggcaggcatcttgtttcatgctaagtagttgtaaaaattcccaaaagtattaaaaagtgtttaaaaagaaaaagactaattcaatcaaaacacatcctcaatttcagtacaattgctctttctgtttggtaaaggaagaaagaataaacatgaccagtaactaccaaatgcttaaattcaaacagcagactacttctcccatatcacctagctcagtcaataaaaagaggccagacagaggcacttccgtataagatgtccaactagagtatcatactaattgaatccaaggcaggcaatcttactatccttaataaataaattcaggcagttattttatgactatagaaagggaaacaaatactactgttaataagttatgtattatacttttttatgttttattaatccagcttgtaggcaaagcctccataccttgaatttactttacctgcattaattaacatttgcaaacattctacagagttgtgataagctgcttcatgaattggcatccatcccctgttatcagcaacatcgacacttcggccctttttgagcagtttccttaagactttaacattgccttccctggcagcaagtccaactgtagagcacgtgtccgcgtaagcctctgtaaaatccatttgtttgaccagtctacaaaacaaggtagaaggataatactatagtcaataaaacaacacttcactcctagaggtcagcaaatcacggtgggcctgtctagtatctctcacatgactgacgaagaagggcccacaatacagaaagtgactgccatgccacagtctctgctggtgcctaaagcaggaagtttctctgtttggcagattggaattccttggaaggttcccactaaaaacatgaagggacttttaagtgttctatctttcctcctctggaaatgtttgaggagtaggcttctgctcctgttcataccccaccacaacgcattctttggtgctccattgataagagcaccctctttggtgctccattgataagagcacctctgcttaatccccagtgtacactacattatgcagagatggccattcaactaccagcaatgctcagcctcaatatacagccctctataggaaacaactaaacccaaagaggccagaaaagcagtgaaagataggtgtcattctagtcttcctgcacctgcttgtcctttccagaagaggttaaacactcagattctctatgcttgaccaaatagacccactgactgagcatactgaaaccaacagagaacaccatgaagagatgagcccggttttcctacatagcccagaaagttcttaacagagttcttgcccacatcatcacctccctccaatgctcacttcaagttcccctccagtcagagtccagtatagctctcatgtgactctctcgaagacacaatttcttgttagtgactctatgaagcagtttggatatggaatacttatttgattacataactattgttaattttctcagatgtgataatggcatcacagttattaggagaatgcccttattctttttttttagggaacttgttctaggatgaatgtccttattcttatgagacacatgtagagtatgtggcagtaaaatgtcataacacaagcaacttcaaatgttctccatttaaaagtataaataaagtaaaaaggaagtacagcaactgtgcaaaatggtaattactggatctagatgaaaggtattggtcattacactctttttatctgagttttctgtgtattcaaaatttttcaaaaaagaagggttagcaaccatatcaggcaatttgaaaccacaacttagagaaaataggaaaagacttgcttttttttttgtttgtttgtctggtagcagcttcctgctgatttctttataagaaaacaaataataccccttgaatctgagtgttttagcattcaagatcatggtataaaaatcttcaagaaagaacaatcacttggtaaggtttctgttttcacacacagagacacagccatgatagtccaagcgaatttcctaaacaatattttgcagcaagagctctaatgagcagatcttcaaaaaattttaggatccttgaccccttggagaaactcatgaaagctgtagtttccccctagaaaagtgtacaccccaaattttgtatacaaattcaggttccccagctcgtttccaaagcctttacaggggccccaagttaagaacatttgcctgctcttttgtgaacaagccaatgataatactaaagatgaataaatttgtgtaaaatttaaatatataaacaattcccattgaaatgacagctactctttcacaagcgtaaacttctattgtaaactttctgcttttatttgaaaggcaaaagacttttttttcaggacataaaatcaaatatgaattacattcctctggctgctgttatataggcaaaaatctaatttccaaagcagaacaaaacgtgtttctaggtgctttgctacctgcggtgctggtacaccgcctccgtatctggacacgagtgacgactcctgctcttttctccttcctcggccccgttagaaataagcccagttccaatttcagagccaaatagctccaaaaagcattgtgggtattgtagttttctgcacacgggcactaaaggtaggttagggtgatttacggatgctgcaaaagaatccattgcttactacaccgaaggtcaatgcctcttgacaccctaatcaaggaaataaaataaagctgactgagatccgctcggaaaatctttctggatctaaactcccagtgcgctttgcgccccaagtggccatcgcgcctgcgccccgcgcggccggttactcgcttaccggaggcttcagtccccggcggcgcggcgacagctagggttcacggccactggggcagaggagccgcgagaagatgtgggtttttggttacgggtccctgatctggaaggtggatttcccctatcaggacaagctggtcggatacatcaccaactacagcaggcgcttctggcagggcagcacggaccaccgcggggtccccggcaaggtgaggcgccggtcagctccccacacttactgccccctgacccctgctccccaactccacacacagcacccacaccctagagaaccacaccttagcgcttcatggggccaaagcacatggcttggggtaacatttctgtagattttccctgccacctgcccgccatctctaacccagcccgggcactccttccgaagctgcttaagatgccggtggttagtytctagagacggcgagaagcgcgggcacaggcgcacgagctcgcaccaggctgagtgcggagatggggactccatctctctgcaacctctgccaaaagaaaaaaagtcccattggcgggaagatgaatgctcatgtcaccacagagttgaaatagtaaatcaagttgcaaattcagctttttagcaattaaatttgttggcatttctgcattctagccgactttcatgagcttgcgattaaacgtgcatgttacttctaggatttctttacatctttcaaaagttttattttctgacacayaggattgcagaatgagtttccaaaattttcgctggttattaaggaactcactttggttttcagtactagtgaagttaaatgaagttctggttatatgaataacatagtaccaaactcattactatatccagcattattttaatgttactttcttgatggttctcataattataatatgaaatgtaagttcattgattcacttttcagtcrgtcctacaaagacattaatctcaatatatgtatagagaattagcagcagctcactgcttatgcaaatcagctttgtactggctacaaaacaactaatccataaagaaaactaagattgaggtaactaataatttggaaattggtcaatggaaagtggaaaagatcaaggcgctaaagtagtttgcamctgctcataagagagacatgggattaaaatcacgaaaagaacctgaattagaaaccattctatctcaactagagttggtcagttaagaacttggcttttaagtagactatactggcctattgggatgttggacacagtgacctgaaaaggggcaatggcttaggataaatgcacatttacagatcaacagaaatgtcatggccaaagtatctccaagaatgttctagaacaatattcaagacattaaagaactaagctaaattaaatggcttctgagttgtcagttttggctgggcccggtagctcacgcctctgatcccaacacttcggaagtttgagccaggaggactgcttgaggccaggagtttgagagttgtcagttttgatatgaatatttaaaattgccattccgaaaagaaaacctttagcccaggctccaattataatgaccaagtattaaatatttatgtatgtggctataacaacatactttactagtcttgacsaaaatgtacagtgtgttacaaaacacattgagatatgtatgctgtcagaatagactgatgattagaaattgcctagtcaacacaacagtccgtgattctttaaaaggagaaaggggctggccaggcgtggtggttcccgcctataatcccagcactttaggaggcctaggcgggtggatcacctgaggtcgggagttcaacaccagcctgaccaacatggagaaaccccctgtctactaaaaatacaaaattagctgggcgtggtggcgcacgccagtagagtcccagctactctggaggctgaggcaggagaatcgcttgggaggcagacgttgcggtgagctgagattgcrccactgcactccagcctgagcaacaagagtgaaattccgtctcaaaaaaaaagagctaaaaaaaggtgtctttctgatcacctaagactcagaattctaactgcacttaataccatacatcttagcccatatcttagctctatttatttcacatgttagtttgcattctagaatgacaatataagctactggaaccaagaatcaagatttcatcttctccacagcacacagtagctatgcataaataacttctaattcactttgaaattgaaaataatatggcattatctacttgaccctcaccaatatatatatatcctcattgtagcatcatcttaaaaagaaaacaagtcagaaatctaaatgtccaagaacacaggaacgtttatagttcatcaatgacacaatattatgcaactattaaaatgtatgagaagactaacaggaaaattaaatgagaaatcataatccaaaatcccatgtgttccatgattacaaattatctatacgaacagatgaagactaaaaggaaatagcaacaaagatgacacaaatgcctggatgatttaggctcgctatgtgccagacattgggcatacaagtaggtaaaattgtggcttatgactcagcattcccatgaatgatgttaaggtatcagtacacatacagcctttggtactccgtggacgaagtttatttaaaaaaaaaaaaaaaaaaaaaaaaagcttgcaggcactgataggtgtcacctttgtgccttaaattatggaacattccaagtctggactttctctaaggctttccatttataaacaaagactgttttatcagtctttgaaatgggagaacaaataaaacttgttttggcttcataatatatcatttcaacctcaagttgaatagtaaaaagtgaagctttccataatattgttaactgacctgtgttaaaaccaaaatgggaaaataaaattgcctagaacacaagtggtctgattgtcccatataagaactacacgaataggccagttctaatactgacctttaaatagggcaaagtaaagttcatttatgaatgtaaaagaaatgcctaccttgaagcaccattaccatatacagaaaggtaagaacacttcataactcagaagtgtaaatcactcattctctctcacttaaaacctcttaatatcccctggtagcagtggttcttaaagtatgagccccagaacaatttctgaaatcagcaggaaagttgttacaaatgcaaattcttagacagctccagacctacagaatcaaaaactctggaggtgtggcctaacaatgtctttgtcaagccctctaggtcattttgatccactaaatttgaaagtcacttccctatatataggaaagcaccctttatgtcatattttttttcccytaataaaactataggccgggtgcggtggctcacgcctgtaatcccagcactttgggaggccgagacgggtggattacctaaggtcaggagttccataccagcctggccaacatggtaaacccgtctctactaaaaatacaaaaattagctgggtgtcttggcgggcacctgtaatcccaactactcaggaggctgaggtgagagaattgcttgagcccgagagttggaggttgcagtgagccaagatcgcaccactgcactccagcctgggcttgttgagcaaaactccgtctcaaaaaataaataaataaataaataaaactataacattcttttttccttaagggaaaaaccagaatatttataattactgcttccatttgcctttcattttagatgacctttagttactggtatgttttccaatatatccatgtaaagtgaatataatatacctaatacgtataaattgatggaaatcttttagaaaggccaacacagtctctagataaggtaggttctcttaattcacttaagctttatcataaaaaataactatgcttaagaaatagtgcttcttatgagcaaatataattcaaatattccatgtcaaaaatgttgctaatgctcagctacttaatgaactttattaattcagaaaaatttttttttacctttttaaaacagcctggaagagttgtgactcttgttgaagatcctgcggtatggtataaatattcttttttgtataattttaattttataaaatgttgcgatgtttctgtttcaatttgattaacaatcatcacagacaatttgaactaccctaaatttagaattcttctctgtatttgtgggttttttttgtgtttgtgaaaactgaggccaataagaaaagttagaatgcagagtgcaaggtagacaacaacgtacagacaaatagcatgtagttttcgtttttgtggggttttttgagacagagtctagctctgtcgcccaggctggagtgcagtggcgcgatctcggctcactgcaagctccgcctcccgggttcacgccattctcctgcctcagcctcccaagtagctgggactacaggcgcccgccaccatgtctggctaattttttgtatttttagtagagacgaggtttcaccgtgttagccaggatggtctcaatctcccgacctcgtgatccgcccgccttggcctcccaaagtgctgggattacaggcatgagccaccgcgcccagccgtgggatttttttaaaaacaagtttattaactaagaattttgtggtcccctttgacattaacggaaatacctgcccccgacagccagactaccaccgagaattaaatggaacccttaaaagctctcttcacttttgctaccagtctcattttcagcagaaatctaagtgaggaattcttattttctttattgcttaattgtatcaatagcacctgtgtgttgtgttttgtgtttttgtttttaagttcaggagtacatgtgcaggatgtgcaagtttgttacataggtaaacatgtgtcatgggggtttgttgtacagattatttcatcacccaggtattaacattaagcctagtatcaattagttatttttctagatcctctccctcctcccaccctccaccctcccgtagaccccagtagaacctgtgattttaaaactggtttggagcaccagaaagttttatttaaccaacaatcctcagtttcttaaatattttcagtcattttattggggtacagattcagaattttatattgtgaaattaaatgtttaactttggaaaggactttaataaacaaaaatcaagcagttagtaatggcagataaataatggtgtggattaggaaatgctttcataattgatactacgaaaagcatttataaaaaagatcttcaaattggtaacttataactcctaattaaacagttaataaacaaatggcactttgtttctagaattttttaatgaccaagtgaaaggctcatatttttcatttcagtcccgttattaaagaaaaagaccaaattaaaaaaaaatttttttaagataaaatatcttgctgtgcctatgatacaaagaaattattcacaatggagattttaaagtgcttatttcctttattgtttagtatgttcttctgtgcactttaagtgaagaaaaactgtattgacttttatttattttttatttttttgagacagtctcactctataacccaggcttgagttcagtggcatgatctcggctcactgccacctctgccacccgggttcaagcaatgctcctgcctcagcctcctgagtagctgggattacaagtgcctgccactgtgcctgactaatttttgtatttttagtaaagacggggtttcaccatcttggccaggctggtcttccactcctgacctcgtgatccactcacctcggcctcccaaagtgctggtattacaggcgtgagccaccgctcctggcccacttttaaaaatatacaagatacaggcaggcatggtggttcacacctgtaatcccagcacactgggaggccgaggcaggtggatcacttgaggtcaggagtttgagaccagcctggccaacgtgacaaaaccccttctctactaaaaatacaaaaattagctgggcatggtggtgcattcctgtaatcccagtcacttgagaggctgaggcaggagaatagcttgaacccgggaggctgaggttgcagtaggccacgatcgtgccactgcaccacagcctgggcaacagacaagactkcatctcaaaaacaaacagaaaagaatatatgagatactcccttagatcacaacctttcttcacctattttaattagccttataataccagtgtattcttttcatttttcaacagggatgtgtatggggtgttgcttacagattgccagtaggaaaggaagaagaagtaaaagcataccttgacttcagagaaaaaggaggctacagaaccacaacagtcattttttatccaaaagatcccacaacaaaaccattcagtgtattgctatatattggaacatgtgataatcctgattatcttggtcctgcacctctggaagacattgctgaacaaatttttaatgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtaacmatggtttaaaatacacaagcttaaaataacatgcttagaaatacacaataatatgaacagtatttcagccttaattgtgaatttccttgttattcaagtattaaatgaaatcttttgagtttttagccaaaaattggcatttttaaaatacraaaatttccttggaattataatgtactgtacctcttcttttttaaataaagrcattttactatatggaaaataactcactaaagcataaattacattatacaaatcatgatcactaatgatgtagtctgtcattcactttgtattaatcttataccaaaactgaaaaagatgggctgatactacaaattaatggcacatataatgaaaatttagtttttaaaacagcttttggaattctttgtctgtcactatctcaatttgtgtgtgtgtgtgtgtatatacatatatatacatataaaattttttttttctttgcagcctgcgtctggccatcccacaggctggaaagtgtaacctctggcagaagccaagaacaggcacctcctggaattataattttgttttgttttttgagacggagtatcgctctgttgcctaggctggagtgcagtggtgccaacctcagctcactgcagccttcacctcccaggttcaaggaattctcctgcctcagcctcccgcgtagctgggattacaggcatgtgccaccacgcccggctaatttttgtatttttagtagagacggggtttcaccatgttggccaagctggtctcgatctcctgacctcaggtgatccaccagcctcagcctcccaaagtgctaggattacaggtgtgagccaccatgcccggcctataattttttatttgtacaaatttatgggctacaagtgccattttgttacctgcatagattgtatttttttaagaagtggcattacctgattatttgtacgtaacttttttctttattttgtcacctaaagaagagtatcaattgggtgtatgctgctactcaactaggaaacaagttattaactcacatagaattaactttgattcaaaccattcaggttattcctgattataggttatttctttctcaagaggacatataatctctctagaatctttcaccataagaacttcagtataaaactaaacacaatatacttactaaaagctccttaaactcaggcatgactaataattagtacagaagtttttcacataaagctgtcctacatgtccttttcatgttttcctatttattaacatcttagtaatttactcagctacatatctactttaaatatcttccaacattttaaatattagttttccagacggcatttcacttgtcctgtaaaacagaaagggtgataaatttattaaatttctaatttaccatccctggttctttctttccaggcaattagatgataaatgtgctttaaaattctcttcatcacatcacgctaaaagttacctatcaaatgttcctgttatgcctatcttttttcagcaaaaatactgactgtattgtctattaatttattcagcttttggcaatctatttttatggatttctaaaaccttgaatttggccagtgtagtggctcacacctgtcatcatagtactctggagtgctgtgatgggatgctgtgaagggaggatcacttcaggttaggagctagagaccagccagagcaacagaggagcaccatctctataaaaaatttaaaaattagccaggtgtagtggcatgcacctgtaggcccagctactcaggaagctgaggcagaactattgcctgaacccaggagttcgaggctgcagtgagccatgatcacaccactgcactccaggctgggcaacagagcaagaccctgtctcaaaaaactaaaataaaaccttgaattcactctaagcatatattacagactcaaagattttgtaatcctgtggctactatgttgaagaattttaactcttccaaagacaattaaaataccaaaatttttcttctgtatgtcaaatttatatgatgaaaattagctttattggatttcagggacttttcattcctatggttcattttacctttctaaaatactatatttcagtttcattttcttggttgttttacttaattgtactgagcctccttctctttataaatggttcgcccacacatgtacacacactgtaactggaaaaaccaccactaatcctacagtttcttgtgttcttccagctttcttattcttcacagaaattttttaactacacagtgcttcacttccttatcaactcgtcttaatccctttccaattcaactttactctgccataccacccaatcattatagtatcaagtctccaatgaccacttcctcactgaacccaaagattgcaattttcatgcttctctggtgcatcagacactagtgatcaagcatcccatgtcactaaagccaaagacaaaaacatttcattgtgtttccagttacaactcttacactattctttatcaaatacacaaactcatcaaatcctaggcttcaattttacttggatagcttccaatctccagcctactctctcaacctcttcatatgtctgttacatgaaggcatctccagttgtgctacacaagcatggaaacttattgtactaaaaccagtactcatctcctttcccaaccagaaaatctggtcccacattacctccctgtacataatacacattaaacgttgaacaatacttagtccaggagaaaaataaacaggtttatgatactcatatcaatttataagcttttggaggaaatagatggtattttcacaatatacacaaaatgtgtttgtgcctttttattaaattttaccctttgttttactaaaaacaatataacattttttaaaaagtgtaagcaatcttggccaggtgtggtagctaacgcctgtaatcccagcactttgggagaccaaggcgggtggatcgcctgaagtcaggagttcgagacctgcctgaccaatatggtgaaaccccgtctctaccaaaaatacaaaaaaattagccaggtgtggtggcgggcacctgtagtcccagctacttgggaggctaagccaggagaattgcttgaacccaggaggcagaggttgcagtgagccaagatggcgccactgcactccagcctgcgcaacagagcaggattcttgtctcaaaaaaaaaaaaaaaaaaaaaaagagtgtaagcaatctttaattggaggccatttggctaagatggtcctaggactctgggttcctatgtaagcaaactgaagcccaatgtaaacagtgaaacaaaacttaatctttgctttttattttttaattataaactgactatagttatatatttatgaggtacaaagtgatgatttatgaatacaatgtggaataattaaatctagttaacatatccatgacctcaaattttttttgtagtgaaaacttttaaaagttactcttagcaagtataaagtacattattagtcactatattcaccatactgtgcaacatatctcaaagaaaaaaattcctcccctttgactatcatctccccattcccccatgccttccctccaaccctggtaaccactgttctactctctgcttcttttagttcaacggttttagattaaatatataagtaagcacatatgttgtttgtctgcttgtacttggcttatctcatttagcttaatgttctccaatccatccatgtcgtcacaaatgacaaagtttctttcatttttaaggctgaatagtattccactacgtatgtacaccagatttttctttatccattcatctgtctaaggacccttaggttgattccgtatcttggctattgtgattaatgctgcaatgaacatgggagtgcagatatctcttcaacatactgatttccaatcttttaggtaaatacccagaagttggattgctggatcatatggtaattctatttttagttttttgaggaactgccactgttttccataacggttgtactaatttacattgccattaacagtgtacagaggttcccctttctccacatgccttgccaacacttatctttcatctgtttgatagtagccattctgacacatattggggtgatatctcatagtggttttaatttgcatttccctgatgattagtaatgttgaacattttttcatgtatctgttggccatttgtatgtcttcttttgagaaatgtctatacaggttccttgcccattttttaactggattatttgtattctttctatagagttatttgagttccttttatattctgaattttaatcccttatctcatgtatggcttgcaaatatttcctcccaatccataggatgtcacaacttaattttaatcagaaaccaacaactattctctaacaagcaactttctgccagattgtacccaaataagacaaacaagtagctatgacaatcaagtaattttttttttttcaagacagggtctcgctctgttgcccaggctggagtgcagtggcacaatcacaactcactgcagcctcaacctcccaggctcaagcaatcctcccacctcagcctcccaagtagctgggactactggcatgtgccaccatgcctggctaatttttgcattttttgtagagatggagtttcaccatgttgcccaggctggtcttgaactcctgagctcaagtgatccacctacctcagcctcccaaaatgatgggattacaggtatgagccactatgcccagtccaatcaagtaatttctttacttcgcttccacattcagcctgcaaaggtctgccgcttactctgttaaaacaagagctccctgaactacttctaattttgggtgctgccaaattcattaatcctttaacacaaaaacaaattctgataaattgatttcgtctaaagtttttcttttaacaaagtcaaaatgaagttaccaaggaagccctgaaggctttttgtgataaggcttaaaagattacatgatagtaaaaggttacatgctgaaagattctcaactaaagagccttatcatacatcaagagccagagtttcttacatattcttcttgtttccaatctcttttcctctttccaatacacgctctactgtgcactcagaattacttacctaaaatatgaaactgaggtcagtaatcaaaatgtcttcctgctgcatataaaataaattcaaatcctttaatctggcattcaactacttaccatctggtcaatctggtatcagtgtatttgtcaaatttcacttcccactgacgtactcccctgcccctcatgctccaatcacaccaccctcctcattctttaagacctagctcaaatgagcgaactaatgttatgtggcaagcaatgactatgcactgagaccaccaaaataaataagatagtccccggctatcaagaatcatatttggtggagaaacacacaagcaaacaaatctatgttatttaatataaaagatgtgatataaaatacaagcagaggggtgggtatggtgctcgtgcctgtaatctcagcaatttgggaggccaaagcaaggggatcacttgaagtcagtagtttgagaccagcctgggcaatatagtgagaccatgtctctacaaaaatgtaaaaattagctgggcatagtggcacatgtctgcagtcctagccactctggaggataaagcagaaggatctcttgagcccagaagttcaaggctgcagtgagctatcataaggcccctacacttcagcctgaacaacacagcaatactctgtctctaaaactaataacaaataaataaaatacaaccagaatacagaaaggcaaattaccaattcaaagtagcagaatcagagaaagcttcatagaaaaaacaaaaaggtgttcatgtgtcagagaataatggttaacacttatgtagcactaactatatgctagattctattccaagtgctttatgtatattaactcatttaatccttattttctacgatgatgaaaattgcttaagtaaaacaaatgtagtatcatttattgaacatttacaacatgccaggaactgtgctaagcactgaacaggaacaaaatgaaattaaggcctacaattttaaaaagaacaaaaaaggaagccgggcaagtggctcacacctgtaatcccagcactttgggaggcttgagggggcaaatcact

SEQ ID NO: 12457 - DNA, 44289 bp, Homo sapiens
aaaacaaatgtagtatcatttattgaacatttacaacatgccaggaactgtgctaagcactgaacaggaacaaaatgaaattaaggcctacaattttaaaaagaacaaaaaaggaagccgggcaagtggctcacacctgtaatcccagcactttgggaggcttgagggggcaaatcacttgagcccaggagttcaagaccagcctgggcaacatggcaaaaccctatctcttacaaaaaatacaaaaaaaattagccaggcgtggtggtgcacacctgtagttccagctactgagaaggctgaggtgggaggatcactttagcccaggaggttgaggctacaatgagccaaaaccatgccattgcactctagtctaggcaacaaagtgagactctgtctccaaaaaaaaaaaaaaaagtgagagatggtagttatctcattttgtacctccattggtagggcttaacccctttgagattctttccattttttttttcttttgagacagagtttcactcttgttgcccagtctggagtacaatggcgccatcttggctcaccacaatgtctgcctcccaggttcaagtgattctcctgcttcagcctccagagtagctgagattacaggcatgagccaccacgcctgtctaattttctattttcaggagagacagggtttctccaggttggtcaggctggtcttgaattcccaacctcaggtgatccgcctgcctcagcctcccaaagtgctgggattacaggcgtgagccaccacgcccggcggagattcttttttaattaggacaaaataaaataggactttttaaaacaggatttaaaagattcacctaattacttatctcctacagccataattttctttttaaacaacagtatgccttgcccaattttttcaacagcattgatttattcaacaagtactggctgggtgccatggctcacatctgtaatcccaacactctgggaaaccaagaattcaaaaaataaaaaaattagctaggcaggctggtgcacacctgtagtcccagctactcaggaggctgaggtgatgggaggatcgcttgagccccagaggttgggatggcagtgagcagtgatcatgcaactgcactctagcccgggtgacaaagcgagaccctgtctcaaaaacaaacaaacaaacaaaaaaacaatggattactcactctatgcaaggcaaactaagcacatacattttcctccgcttcctaacaaaatcgcactgaaatgcactcattcattctggaagagaaagcaggtaggattatgctgaggattaagccagtgcagagaaaactgcagtccagaacacacacacatgcatacatgagaaggctatagcaatgtagaagacattcttgccagcagagcctggagaggtaccaatcttagaaacaagcagaggaaggacgtaggactaaaatcagaattattataatatttatatgaaacagcaagccaaactttttaccacagccctttacacacaaaacgcctggcagcaacagtatttgtttctggctaaaaccacatctattttgttgttattgctctttttaatttaacagtctaccctggaagcctttgagcatcttcatgttccataacaaagcattccttatttgggtacagggtggaaggagaggaggaaagaggcaactcgtttcttgcacttcactcaaggaccctaaagttagacccaacagctagtaccctgctcacttacaaaagagctcaataatttttttttttttagatgaagtttcacttttgtcatccaggctggagtgcaatggcgcaatctcggctcactgcaacctccgcctcccaggtttaagtgattctcctgccccagcctcttgagtagctgggattacagaagcctgccaagacttccggctaatttttttattttcggagagacagggtttcaccatgttggccaggctggtcttgaccttccagacctcaggtgatctctcaaagtgctggaattaccggtgtgagccactatgccccgccaagaatttttttttttgaagtaaaagcacaacagacagaaaggatgaaaataaacaactgacctgaaagaagcagagctatttccgggaatgggacataaatatttaaaagttataagtgttatcctcaaagaaattcatgtcatgagaacaatgcatccattaaaaataactagatgactagaaactgtggggaaaaaaccactgaaaaaagaaagtgaaaagaactgaaaatcaaggaaatggacctcttggattgatccttcgtattatgtattttttctttttatatttttcctctgtatttggaagaatctatctaaatgtatttggaagaacctatctaaattctgaatagaacagagaaaatgtcaagaacataattaaagaaataattgaagaaaatttcccagaagtgaaaaataggattcatagagtgccaagaaggatgaatgaaaaaagattcaccacctagaaacactgataaaatatcacagaaccaatgataaagaaaacagtctaataaaatcttccagagaaaaaagtatgatacctgcaaaagaaagagactggcattagacttgtcatcagatacactagacacaaaaagcaagagaatgtcttcagagttttgaagaaaacaaaatgattgtggactaagtctattcccaagctatcattaaatgagcaggcaaggtaaaggcattttcagacatatgaagtctgtggaaattaaattacctgtttaatccttcctgaaaaaaattgcttgaaattagttatacccctacaaggtgggaaaaaaatctatgacaaatgaggacatggaatacataaagcagtagacctaacccaggcatgatacaaaaaaatctcagtaaacaggtatgcaactgacttgtaaagcaactagtctaaattacatgtgtgagagctggaaatacagcttcaggagcaaaatgagtttattttagcaaacatggtgccattattaggaagctaataggataccttaattggcagaggtagaattacattttttctctgcagatgcaatcatacttaatagttttatagcgaatgatgattgtataattacaatatggtaaatagttgataagttttcaatgtttaagaatcaacctataaataaagcataaaagacttgtactgattgatgtcctgtggctccttaaaatgtgtaaaacccaagtgtagcccgaccactttgggcacatgctgtcaggacctcctgaggctgtctgtgacacgtccttaaccttggcaaaataaacttctaaactggttgagacttgtctcaactactttttggttttcatcctctattaccttcctgaggctgctgtaacaaatgaccacaaactgagcagcttagacagcataaattgattgtctcacaattctagaaactagaggtcagaaatcaagatgtcagcagggctattctctctctctgaaagctctaaagaaggattcttccttgcctcttcctagcttgtggtgattactggcaatctttagcattccttgtcttatagacacatactgcaatcttgctgcctcctccttcctggcatggcattctccctgtgtgtccatgtgtatccaaatttccctcttcttataaagataccagtcaccagattagggccccctttgattcagtatgacctcatccttacttgaattatatttgcaaagaccctatcccaagtagttcacactcacaggttctaggggataggacttaaacatgtctttttggggaacacaattcaacccacaacaccccctacaatcaattttccacacagcagccacaatgatcttcacaaatgtacatcgggtcctgtccactctcctgcctacagagctgtctccctggcctctttctgcttctcaaacttcttctaccactttcctcttacactccagccacactggccttctttctatcactccaacacatcaagctcattcctgcctcagggcctctgcctagaaatttgtctggctcccttcttttcatcattcaagtcacaattcaaatgtcacttcctcacagaagtctcctctgacttacgtactaaaagcaacacatcctacaggtattgtctttcacataaccttagtttctttgcagcacttaccaatactagaaattattttacttatttaagttcccctcttacttgaacatcagctctattgaacacagattcaatcactatagccctaaatgctaaaacaggacctcacagacagttttcatttttattccgtcaaatacatctcttttccttcatgacttaagactagtgcttagcacagaataaatgctaaaaaaaaaaaaaattgactattactactataatagtttgcaattatttgtttgtacaatctccctgcctagactgtgtgaccaaagacagaaacccatttatttggcattttaccaagcccaggggggccaggcacagtggctcaggcctgtaatcccagcactttggaaggccgaggagggcggatcacccgaggtcaggagttcgagaccagcctggccaacgtggtgaaaccctgcctctactaaaaatacaaaaattagggtgtagcggcgcgcgcctgtaatcccaactactcggaaggctgagaaaaaggagaatcccttgaactccagaggcggaggttgcagtgagccaagattatgcctctgcactccagcctgggtgacagagcgagactttgtctcaaaacaaacaacaacaacaaaaatcccaggagtctggatcacattaagcattaataagaagtgctgaatataattagcgaataacaattctgaagaaagttatcttctttgatactatggattcctgatgttaaaaaaaaatttttaagatagaatatgggactgtccttcctgctttttgatttggttcaaatctgaggaagtgggggcgaccagtctttaacagatctagcaagactgtcgagctttagggaatggtaatttctctaaagccaacactctatgtccattatattggagatcaaaacagacaatggcattttttctaaagagggggagggaaaaacaaaactttttgtctaatttggggatgcagtcagacgtgacttagttcataaacacacacattcatctggcgctaaacctcacataaggaaccttaccagcttccttgataaaacaacaccccaacacttcaatctagagatggagggtaaaaatgtagggttgtgatgtctagctgcccattccacgagagtcgcccaccacgccaaattcggaggcttgcggtattcacctacggggagatggcgggctacctcaccccaggtttcccctaacacagagttgcagtcgctgaacaaactgccctgcgttagtcagaagctgttaagtaacgagatggccacggtccacagcagaagagatggagataagcctcaagcgggaaaaatgaagtgtacaaatgccaaatgcggagaaaaagaagaaaagctgcaagaaggcaggtcagtcaggaacaccgccatttctcacatctcatcgctacttcgaattttctcatctaaggacccgcacccgcacggttcacactgtcttcttcccgctatcactccgtgtgggtcaaacctctgcctgcccactggagagcagcgggaatggcttcaggaagcggctgccgcctccgagactcaccgacctgccgtgctgccacttctacaccgaaatggctggtccgaggccgcgtctccagagctgcgtcccagaagcccccgctttcgatccccaccgcgatgctgcagccgtccgaaaacgagagacgcgcaggcgacgtcccggcccccgtaggcggacggctccgcgacccccggatgttgatatgtcgtctgccccggaaacggtgacaggaggctcaagggggcggaggcggcgttgccgggctctccggaaggagacgtggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctggtcagtgccctcactaaccccgcagccacccctcctcctgacactaagkgttcggcctcttccctcggttttctttgctttttctccccaagaccttctctgcagactcttaccttccccaagccaaagctgcttttatgcagcgttcattcattcgttcgttctcacgttatgtggatgcgtcccccttgctgagcattagggatccagcaatcacctgctctccaccttttcaattctgtcgcactagaccttgcttcccaacattcccaccctgcagaagcagctttcgtagaataacgtcaggtgcacttactcatcttcctttcggaaaattaactgtggctcttacttcaccagcagacttctttccttcagtattacatgtcaccctgcccacaccacagtacttcagactcgagttccctctctcgtattcgttctccctcagttgtatacacacacggacatacgcaaacgcacagctccaagggaactttttcctttcctagttgtttctgagagggctatttggcctgtgagatgttaacgaccctttatgcagaatatcctttacagttttcatgtattacgactgttatttgagtccccagaacatgagcttctatgttgagttttcctgtagtgaagaacatttgtaacctcgcggaaatgaaaattccctcttgggggagtggaccgctgaaaagtcttcctgtccacgtgtacctactgcaggctaataaatattgtactcttatgacacttaccatgtagtaattaactcatttacttcaaattgaagtcccggaaaaagcaaaatttttttaaactttttattccaattaccttcaagcattcaacttgcaatactttattatattctttcattaycatttcattgaaacagtaagtgacactatgatgtcaaaacaagatgtgtcaagttaatggatgttattaccacatagctttctatttgcaagtgttaggggttttttggtttggtttggtttggkttgggtttttctgtttttgtttgttttttgagacagggtctcagtctgttgcccattctgaagtgcagtggtacggtcaccactggctgcagcctcgacctcctgggctcaagagatctcctcagcttcccagtagctgggactatagggaaatcccaccactcctggctaatttttttttttttttctagaggcagggtctcactatgttgcctaggctggtctcgaactcctgggctcaagcaatcctcgtgcctgagcctcccagaatactgggattacatgtgtgaaccaaatgttctgaatttatctaggtaaatatttttctgggacgtcaaatttctctttgtattaatgccacaaaatattgatacattgaaatacctatgtaaaattttgttatgaatcagatataactttagcaggcttggaagagaatactttaatmyctgttgttgtatccaaagagcacacttggagtgaatatggcagatgtttgaagaattatgtcattaaaattttttactcttggcacctgtgttttttttaatttaaaaaaacttgctgatatgcagccctgaaaacttactataagcgagcgactaaaactagcatttttagaggtcactaccaaattgtcattccattttctttcagtcttagcatttgctacaccaacttttcacgtatctaacaattttatttcaaaaaaaaaatgctttggccatgtgcggcggctcacatctgtaatcccagcactttgggaggcagaggcaggcggattatgaggtcaggaattcaagacaagcctgaccaacgtggtgaaaccccatctctactaaaaacacaaaaattagctgggcgtggtggtgcacaccagtgctcccagctacttgggaggccgaggcaggagaatcgcttaaacccgggaggtggaggttgcactgagccaagattgcaccactgcactccagcctgggtgacagagtgagactctgtctcaaaaaaaaaaaaaaaaaaaaaaattctttttttagaagctggagtgcagtaggtatttataggcatgattatgctcactacagcctcaaactcctgggctcaagccatccttctgcctcagcctcctgaacagcgaggactacaggtggtcaccattgcatctggcttttttttctttaagtctgtgctactttgagaaaaatctagagtgttctgtgaattgtcacaaggcctatgtcctttatgtaaaaataagccacaatagtcattatcattggtcttttgattttttttaatacttctataaccttaaggcttccctttgcatttaactgaaattactggctgggcacagtggctgacgcctataatcccaacattttgggaggccgagctgggtggattacttgagcccaggagtttgagactagcctaggcaacatggcgaaaccttgtctctactaaaaataaaaaaattagccgggcatggtggcacatgtctgtagttccagctacttgggaggctgaggcaggagaatcgcttgaaccttggaggcagaagttgcagtgatccgagatcatgccactgcactccatcctgggcgacagaggagtctgtctcaaaaaaaaaaaaaaaagaaaagaaaagaaaccactactctcctcacctggcgctgccattttttttaatgggccagttggttggacatttgtgtttgtgacagagtctcgctctgtcacccaggctagagtacaatggcgccatctcagcttactgcaacttctgcctcccgggttcaagcgattcttgttgcccagcctccccagtagctgggattgtaagcgtgcgctaccacacctggctaatttttttttgtatttttagtagagatgaggtttcaccattttggccaggctggtctcaaactcctgaactcaagtgatccgcccacctcggcctcccaaagtgctgggattacaggcatgagccaccgtgcctggccgcgggttggacatttgtatctaactaatatgcagctgtatgaaataggataaggtcctttgtctgtttactaactgaaattggaagagactggattagaagatctgmattttttaagctttaaaattgtctgctttaaattgtcttcccattcagatatatcaaaacaatatataattatttacaatcttgctttcagatttgcttagaaaaagtattaagcaccaaaactgtaaaatgggggttgtttgtgtgttttggtagagatagtttccctatgttgctcatgctggtttcaaactcctggtcaaaactatcctctggtctcagcctcttaaagcgctgggattataggcatgagccacctcacctggccaaaaaatttgtgtatttttgatgtgtacattaactagagttaataattatgatattctttgcttattgatgtttagcactcagttttgtttttgtgttaatattttccttctgaagtatcacctctgtcgttatgtttaattattcattactttatagagttcagagatttcaccaaattaaaccacaaatcagtctaattttctgtctacttctgttgttgatgtagaatatattttactcagattttcccaagcactactatttgaccaactccatggtttatagcatgtcatatacattgacaggttctaccaacaagtgtattttatagcctctaccagaatagaagttctctcatcctctaaccaacctaattcctccagacccacgtcaaacattaggagttcctctcatgccaagatattttttaagttccttaacttttaaagtaccccagcacctctgattagtttcactatattaaaatttgactttatgtcaaatctctaataaaatttgactttgtcagatctctaataaaatttgactttgtgtcaaatcgctaatttcctcttccactgaaaataccttgttatgtaaagtaagttttttatactatctaattctgtacattcagaatttattatattttgttttcttaaagtaaaacctgttttatacaatcagaatcctgattttagtggatccgaatttttagaaaaattataaaagataaactttttctccgtaattcctgttaccaaaaagtaaagtttgctaaaaatatattttgtggtcccaataagtgactcactatttcagcagagttttcagatagaattgctatttggcttattttattgggaaagcagcctttcctaaactaatgaaagactattatttgcatcaagaattgtcttcccttttttgctgtggttccaaacaagcagtttctttttacatttgaagcattttggagaccattttgaaaggaattacaaatgttatgtctyatagcaaatcgttggcacaattgaataaatgtttctaagaaattctttatcataagtttagctttgcaactgttactttcaaatctctttgattccctcatcatctataatgctcttttaaaaaaaaaaaaaaaaaaaaaaaaagacggagcctcgctctttcgcccaggctagagtgcagtggcgaggtctcagctctctgcaagctccgcctcccgggttcacgccattcacctgcctcagcctcccgagtagctgggagtacaggcgcccgccaccacggccggctaaattttttttgtatttttagtagagacagggtttcaccgtcttagccaggatagtctggatctcctgccctctatctgatccgcccgtttcggcctcccaaagtgctgggattaccggcgtgagccaccgcgccaggcctttttttttttttttttaataagttgcccaggctggggtcaagcagttctcccgcctcagcctcctgagtagctgagattacaggtgcacatcttacttacagtggctttttaaacaagtatccttggccataattcaagtctgcatagtaatctaggagaagtttgtgaaagctgattcaaatatgttaaaatatttaaaagctcacagaatatggagccaatctgtttgaattctctggcctctgctacttctaggttttttaaccttggacaaatggttgaagccctgggcgttagtgtctgtttccgtaaaaatgagcatcatacttgttttgaggattaatgagttaatgaatgtaaaacacttaaaacagtactgtcctagaactaatacagctagtacttactgctttgttttgttttttttgtcttagggaaaatgctgtaatttgcttttgtgtttaggattacagtggtgccaagtagtactggttttattatagttaaacagttgttaggccagggcagtggctcacgcctgtaatcccaacactttgggagacagaggctgacggatggcttgagcctaggagtttgagacccacctgggcaagaggataaaaccccttctctacagaaaaattaccggggcatggtggcatgtacctgtagtcccagctactagggaggctaaggcgggaggatcacctgagtccaggaggtcaggctgcagtgagctgtgatcatgtcactgcactcagcctgggttagtgaaagaccctgtctcaaaaaaaaaaaaaaagttattgttaaattgagaatagaacaaaggtccttaataagaagaggttctccttgccaggaatagccaaatagtaccatagttgcacagtaccataagaggaaagtgaagagagaattgaattatcttagaacatgtgtcataaaacacaaaaatctctgccttagtaaaatgagtatcacatttgctatcaggaagcagagatttgtttttactaaaataatatctgttgtattaattgaagtgtttatttgaattctgttgactcatattaaccaatgtgaatttgtttggtttcatagtgtagaaagctttaaggataattttgtcaatatatgccagaagtcagcaaactacagccattgcgctgtcccaccacatatttttataaataaggttctattagtacatcatcatccgtatttgtttacatattgtgtacttttgttgctacagtggcagaggcgcaacagagaccatatggctcacaaagcctaaatatttactctctggccctttacaaaagtttaataagtgctcagtgatggtgtatctatgaacattcattgccacctcttagtgcctttttttctttttttcttttttttttgtaacagggtcttgctatgttgctcaggctgatcttgaactcctgggctaaagtagtcctcccacctcaacctcccaagtataatcactattttaacttcaatctgttgcattcctccttttttctttatactccaaacattattttgttcatttattttcctattatgacacaggataaagtttatcttcattttgtaattaataaatatgttgataaaaccaccaaaaagaatgaaagcatgtcctttgcaaccacatggatgcagcttggaggtcattatcttaagtgaattaagacagaaactgaaaaccaaataccgtatgttttcatttataagtggaggctaagtgttgaatacacactcaaagacgagaacaataaacactggagattccaaaagacaggagagagggaggggtgacaaactacctatgaagtattaggatactatgttsaatacttgggtgacagggatattagaagctcagacttcatcatcatgcaatatatccatgtaacaaacctgcacatgtaccccccgaatctaaaatttttgttaatgtttgtagcatattttccctccctttaaaataatcatctgttgaaatgttaaattagtttaaagaatcttttttccagctaagactaaagttattcagtgtgatacaatttcacggagaacataatgtatgttttttcttctatttgcagcccacaactggagttttatataaagaagataattatgtcatcatgacaactgcacataaagaaaaatataaatgcatacttccccttgtgacaagtggggatgaggtaagtttttataaatatattgataatcctgtcaccaaaaatatttatgtaaaacattgtaactacatactttgaagtaaaattgaataacagatttctcaataacgctcttttagcataaaaatagtaatcacttttaatatccctgaattctttgattttgcagtttatcttgggaaaaattagcaatcaatttttttttattttatttatttatttattttgagacgaagtctcactctatcgccaggctggagggcagtggcacgatcttggctcactgcaacctccgactcccgggttcaagaaattctcctgtctcagcctcccaagtagctgggattacaggcacacaccaccacacccagctaatttttgtatttttagtagagacggggttttaccatgttggccaggatggtctcgatttcttgacctcatgatctgcccacctcggcctcccaaagtgctgggattacaggcatgagacaccatgcccggccgcaaccaattattaacgttttgaatgaaaatctaactccacacttgctttctttatagaaattagggttttaaaacaagataacaatttttaaatgtatatgtgactttttaaataaatgattgtttataaataagtctgtaggtaccccatgctttctcattatcttagcccatgccsttttcttcctcctaaaatgccctaattgcctcttatccatccttcaaggcaatgacttctttcaagatgaaacaggagaggcagcatggtaaaatgggaaggacaccrgcctaggagccaggaggctgaggtataggctatagctagctgtggaaccttgaacaaatttgaaactgacttcctccactcaataaatttattaagccaattcagtaatattttcatgatctggaaaatagaaatattaaactcagtgctttattgggttttgttcagatttgaaatcaaagaccactgttttaagtctccttgagacacacacacacacgcacacggcattcaaatctgaaatgtaaaaatacataaaaaactgaaaagtgccttaaaactttccaatatatcctataagattcaactattctaagggctttcatagctaagaatttgtttgggtacaagcatttaaaaattctgaaataggtttataagaattgttcaggaaactgatacttaaaaaccttttttccctccattcttgccttgtgaaaagcaaaaatacatttwaaaaaaacctttttttaagaaagcatgaactctgtgaagattattttacggctccatattttatacttcagttatttgaaagcaatggcgtaccgtagggtcttgttaaacattttgacttttttttctcttttatttctaagcatttgtgatttgagtaatgagttaatatccaaacagcaaagttgggtgaaattctagaaaaactgtaagtattaaactccaattctttcttaggaagaagaaaaggattataaaggccctaatccaagagagcttttggagccactatttaaacaaagcagttgttcctacagagtatgtatttyatgtttacttgatgactagaaaatagattaccaacagccaacagacctttgaaaataccgtttcttctttattatgttgtgtcaggtttttttttttaactattattttaggtttagggttacctgtgcaggattgttatataggtaaactgcatgtcacyggggtttggtgtacagattatttagtcacctagataatgaatatagtacctgatgggttggtttttttttttttttttcttttaatcctctccctcctcccattctttaccttcaagaaggccctaagtctgttattcccctctttgtgtccatgtgttctcattttttagctcccatttatataaatgagaacatacagtatttggttctctgttcctattgtatcagatgttaagttaggtataaatataaattatttctttttttttctttctttgcttttttctttttgagaaaaggtctcattctgtcacccaggctagagtatagtggcatgatcacgattcactgcagccccaacgtcccatgctcaagctgttctcccacctcagactccccagtagctgagcaccaccatgccctgctaatttttgtattttttataaaaatgaggtttttcacagtgttgcccagactagtctcagactcctgaactcaagccatccacccgcctcagccttttaaagtgctagaattacaggcgtgagcgactgtgcccagctagttatttcttaataatatcttattcatttaaattcctgtctagtgtatgcagcagatacccaataataccaataacaaatcatatcacttaccaagctgttttgaatgtttttcagttcaaaataaagttttctttttcttttttttttttttttttttgagacagagtttcactccgtcacccaggctggagtgcagtggcacgatctcagctcactgcaacctccgcctgccaggttcaagcgcttcttctgcctcagcctcccaagtagctagggttacacacacgcgctaccacatcccgctaatttttttgtattttttagtagagatggggttttgccatgttggccaagctggtctcgaactcctggtctcaagtgatctgcccaccttggcctcccaaagtgctgggattacaggcgtaagccagtacaccsggccgagtatataatagaattttaatttaaattgctaattgttattttttaagctatgtagaaaattgtccctaagccaggtaattattacagaccccaagtgtattctagacctatttccttcacagaattctcacatagagctagtgaaaataatgaatagacttcagaaatttcacatttttttgaggcataattataagtgtcatttaatgaaagcttactctgaaatcttaggggaagtctcagctgcttcaaatatcagaaagtaattcagctgagttatgtggsttttgtgyattgaaatatatccatcttttttagattgagtcttattggacttacgaagtatgtcatggaaaacacattcggcagtaccatgaagagaaagaaactggtcaggtgtgtttttcttcaaaatattattatgaaacattataagatgagaactttaataatgagattgatagttttaaagttgtatccttaaaaatgtctttgcaaaatacttagtatatttttattttacttttcaatgtagaaaataaatattcacgagtactaccttgggaatatgttggccaagaaccttctatttgaaaaaggttggtgtctacccagtgatttgasagtaatgctggaatttggtttaaaatatatgttcaaaatggaatttacgagattttttttttggacattgtgtgaattttaaaatactgaaataggctgggcgcggtggctgacgcgtgtaatcccagcactttgggaggccaaggcaggaggatcacaaggtcgggagattgagaccatcctggctaacacggtgaaaccccgtctctattaaaaatacaaaaattagccgggcgtggtggcrgacgcctgtagtcccagctacttgggaggctgaggcaggagcatggcatgaacacaggaggcggagcttgcagtgagccgagatggcrccactgcactccagcctgggcaacagagtgagactccatttcaaaataaaataaaatactgaaatgggcttctgaactgtcccttacaaaactttcaaagaagtctttgttttcacctttttttttttagacagattctctctttgtcacccaggccggagtgcggtggcacaaccacagctcattgcagccttgacctcctgggctcaagtgatcctcctgcctcagcctcccaagtagctgggaccacaggcacatgccaccatgcccactaattttcgtatttgttgtagagatggaatttcgccatgttgcccaggctggtctcaaactcctggctcaggcgatccccctacccaaacctcccaaagtcctgggatcgtatgcatgaggatgagccaccatgcacagcctaaaagctttactaaaataagtaagaaaaaaacatgtttatcaaagcagaaaatagtgaaaacaatgccaggtgcatgttagtgttatatataagtgttagtcttctgcttggcttaagcaaagttattatatgtagaaatagatatatctctcaaattgtgaaatatgtttattctatattcagattggtcagttaatttaatattaaatttttcactgagataaaaatacctcgaaagaaaattgttgtggccagttttctacctgaaatagagtatttcctgggtaaagattaaatatgacttcctttcatacaaaaccatttcaaggaaactagctttaaagtagtaagataaaaatcatatgtgttttggaccttctttagaaagaagattaaggttacaaaggtggttgaaaacttactcatttgtaccacatatgtcactgctcattctttacacttaccttattattccacagaacgagaagcagaagaaaaggaaaaatcaaatgaggcaagtgacagatgttgatttttttcctcttaacacttattgttagtgaggtatgaatttatataacccaagtgacagaatatatctttatgttcttattcttcatctatcaaataccttgaaggactgggtcaaagaatctttgcagtatattccttttttccgagaaaagttacactgtggtctttctatttactcttaagattatacaaaaataaatctatcactgatgtatctggggaagattctgtaatagcattatatcacttacgtgcttagcagtggttccctctatataacactggaaactattaagagttttggtccccatttcctgtgggcaaaacaggtaaactataatgtaaataacaagctaccaaactgcaagcatgttaaaagcagggacagtcttttatctctttaccccacagtacaaagcagagtgtcagacatattataggcacttcataaatgttaatagaaagaatggataaatgatttctgtaacatagggacgtttaaaaagaataattcctcaggaaatctaatcacaatttttaaatcccaaaaatttttatagagtttttaaaaataacttattaatagaggatatttccataaatggcttaatatcatactgatactttttttagaagtaaagtaaaatggcaaagtctttgaaaattacttaaaagtgatgcctataactttaaagggtagctttggagagacttgataagctaagcagagacacacatagcattgctattttaaaagattttaattttatagactacctttgagattaaaatagttatttactgtgactctgaaagacagcaaaagatggaattcaaagtgtaaaatgataaaggaagaggaagaaaatggtaagggaagaaaactattttttgagccccagtttataagccagacactgccagacatttaacaaaagctaatgtttaattctcccaaaaaccttttaatacacagtcatgaatcgcttagcagtggaggtgcattatgagaattatgtggttacgtgattttatcattgtgcaaacataatagagtgtacttacacaaacctacgtggtatgtgtatttttatttatattttttccccatagaaaaccaagttcgcagtaccattacagaatatcagtcatttctgctaccgcaatgccaatatcaaatacgatatatcagatttctgatatatgctccattacaatcttatggggccattgtcttatataaggtccattgttgaccaaaacatcattatgcagtgcatgactgtatattattattctgcttttacaaatgataaaaactgaaatttattcaaagccataaatctagtaaatttaaagcttggatttgaacccaggattttctaatttcagacactagcttaaaaatcacatacatataaggaaatctcaaaacattttttcctgaaaacattatttattctggtttcggacatagtgctgatagggtactaaagtgatagaagatgagatccctgcctccaaagagcttgtttggagatattattaacagtgcctttttaaagttcttagagtggatttttcttgtgtttatgtagagaaaagtrtaggagctaacttcttagtgatctttgtcttctcaggttctatcctttattccttcattccatgaaaaatttttaatttgtcttttgctggccttgagtatatttatataggagtttacatgctggatagtattgctgttaatattaaaaacggggaagaagagtaagtagattgatgaaccagtcagtactgtatttaaacttctgttttagaatagtgtgttttactatacaaccctattttttggcaaatcagccttcagacctatcaaatctaaactctaatatagccatttaccgagagtttagagaagaaagctctgagcagcccagtatagtaagtttctatattttatcttagtctctttctttagaactgttgagaataattcatattaatcattattttgtagccctttatataaatgtacatttacttaacatgttaattttggcactaaataatctttttgctgtattaaactagctctgaaaatacatatttgctcaaataaaaacttacgaatcaaaataatattagagggagaacttaaaatatagaagtgttacctttcagttaattagtaaaatgtagttttcttcctttcagaataataagttcctctcccacccccagtcccatctccatgtctaatgaaaagtctgtcttatactctttttttttaagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaarttgtcattttgacaccactcttgtgcagtcatcctaaatataggtaggatgtgcatttaatattttaaacataaaatgcacacatgctttaaagtgttctgtgcatagctttaatgctttgttcctactgaacaggttcagagcatctcctgtgaatgacatattttgtcaatcactgccaggatctccatttaagcccctcaccctgaggcagctggagcagcaggaagaaatactaagggtgccttttaggagaaataaagaggtatgagaattgtctaatgatagctttttggtgcttcatttttaaaatttcagagcatatgtcaatattttaatgatttctgtagtataatggtagtaatttattttactggcccaaccttttgaatttcatttcttttcattgattttaatccttttccttattctagtactactcaaactattttaatattctcttatattcataatttcataatattttaaagtttsacatcctactcattataatttaatttttaggtatttgtcccagctaaccctcttgaaaaatagactaaaaccctatctctgtctcctgatacattattaattcttcagctcattgctgcccttttaaccacttctctacactgcctccccattttaatatattgtcttccattttcatctgcctactgggcatagccatatatacatttttaataatytcacactcatcatttttttctctttcatactgacccttttcttgccttctcctgtgttctacccaattgaccaattagaaacctaagtcttttttcttacctgtatctcttcatttatctctaactctaatcatccactaaaaggtatcagtgttatcttctaaaggctttttaaatccatcctgtcattagttcaggacttcattatttcttggaaccagaaactggtctcttaacacatcccctttctaattcttcccacacagctgataaaatgctctttctgaaatcaccctttgattatgtgtttaatctcttggtagttaacacatactacatctcaggatagaatcatcactcgtgtaatacaaacccctttgtggtctgatttcagcctcatctttcatcaccattcccttcatcccagctgttttgaacagcttagagtttcttaaaagtaccgcggagttttgctctctcacccaggctggagtgcagtggcatgatctcggcttactgcagtctccgcctccctagttcaagcaattctcctgcctcagcctttcaaagtgctgggattacaagcgtgcaccacctcacccagccctacttgaccttcagtatattgttttcttcttctcttgcgttgtcccctcccaccccttctgctcatgaacttctacttaggcttgaagatgtgattccaatgttacttcctttggaaatgagccaaaacttccagtggattaacccaggaagagataactacttcctcttctgtggtcttgtatttcattcagacctccatcatagcacttacatggctaagactgattgttttacctatggatgtttcattaaaccagaaggcagaagaaacatacttggctgcaaggcttgtttctttgcttcctcttgagtacttctgcaaaaatattactggactctttgtgcatgttgtgaccaacactgtcattctgataggaggaaaatgtgattaattccacagtttaatttgaaatgctatattaaaagatttgggctagaattctcttctggtcttcgttttgatagtgaagtatactggcacatacttaaaagttagctcaatcaaaatgcttcataaatcccagctttcgttactcttcaaggaaaagatgccagtttacttctctttaaataatgtgtttagtctgggcatggtggctcatgcctataatcccaacactttgggaggccgaggcaggaggattgcttgaagccaggagttcaataccagactagacaactaaaaccctgtctctacaaaaaaaaaaaaaaaaattcagccagtgatataaaagtcgtgctagcatatagctgtagtcccagctacacagcaggctgaagtaggaggatcacttgagcccaggaattcaaggttgcactcaacctrggtaaaaagagtgagaccctatctcaaaattaattaattaaataataggtttaatctgccagtcragaaaaattgaattttttaaagctacagatgataatgctttaaaaatatttagcataggccaggcacatggcccacgcctataattccagcactttgggaggccgaggcagtcagatcacttgaggtcaggagttcaagaccagcctggccaacctggcaaaaccccatctctactaaaaatacaaaaaaattagccaggcacggtgatacacacctgcagtcccagctactcgggaggatgaggcacaagaatggctcgaacctgggcagcggagcttgcagttagccaagattgcaccactgcactccagcctgggcgacaaagcgagactccacctcaacaaaaaatgaaaataaaaaaataaaaatactcagcattttttttaatttctaatttttgtgggtacatagcaggtgtatatatttatggagtacatgagatattttacatatactcttttgttgttgttgttgtttttgagacagagtttcactctttcccctaagytggagtgctgtggtgcaatcttggctcactgtggcgcaatcttggctcactgcaacctccatctcctgggttcaagtggttcttgtgccttggcctcctgagtagctgggactataggcacgtgtcaccatgcccagctaattcttatatttttttagtagagacagggttttgccatgttgcccaggcgggtctcgaactcctggcctcaagtgatctgcttacctcggccttccacagtgctgggattacaggcatgagccaccacgtgtggccgggtacatgagatattttgatacagatatgcagtgcataataatcacatcttggagaatgaggtagccatcccctcaagcatttgtcctttgtgttacaaacaatccaatgagactcttttagtattattgactatagtcaccctgttgttctatcaagtagtaggtcttrttcattctaagaggttttttttgtacccattaaccatccccacctccttcacaacctcccactacccttcccagcctatagtaaccatccttctactctctatctccatgcattcaattgttttgatttttagatcccgtaaataagtgagaacatgggatgtttgtttttccgtgcatggcttatttcacttaacataatgatctccaattccatccacgttgttgcaaatgacaggatctctttttttttttttttttttttttgagatggagtctcactctgttgcccaggctggagtgcagtggtgcaatctctgctcactccaacctccaactcctggtttcaagtgattctcctccaactcctggtttcaagtgattctcctgcctcagcctcctgagtagctgggattacaggcacccaccaccatgcccggctaatttttgtatttttagtagagatggggtttcaccatcttgggcaagctggtctcgaactcctgacctcagatgatccacccacctcagcctcccaaagtacgggattacagacatgagccaccgcacccagctacaggatcttattcttatttattgctgaatagtactccattgtgtatatgtaccctttttttaattaattttttttagtagagaaagggtcttgctatgttgcccgggctggtttcgaactcctgagctcaagcattcctcctgccttggcctcccaaagtgctaggattacaggtgtgaaccactgcagctggacgaccctacattttctttatccattcatctgttgatggacacttaggttgtttccaaatgttggctgttgtgaacagtgctgcaacaaacatggaagtgcagatatctcttcaatatactgatttcctttcttttgggtatagacccagcagtgggattgctggatcttataataattctatttctagttttttgagaaagctccagactgttctgtatagtgtttgtactaatttacattcccaccaacagtatacaagggttacctttccacacatccttgccagcatttcttattgcctgtcttttggataaaagccgttttaactggggtcagatgatatctcattgtagttttgatttgcttttctctgatgatcaatgatgttgatacttagtatctttagggtacatgtgccatatgaaaatcttaggtgatactgtaggatgagtagttagttaaaactgataatctttatttcagaatcactttttcataaatctgttaaacgtaacttttcttttgaaaatgtacatttagcatatggtttgcctctttagtgtgggtcagcctttcccatacagataaacactttttttcttttataaacaaaaatataaatctggctatcagagttttggtttgatgttctgcctgttatgttaatttagagattactggactattaggagtccatgtaatgaattttctactctactatataaactaccatcctatttttattagaataattttccttaaaaatgaaaatggatgttctgtccagaagaagtagtaataaagggtcatgcttctattcttgccacctcttccccttatctcagctgcaggtttcactatgcagcattattgtttttcttcattaaccttaatagaggtctcatgtattcccaggttattagtttagtctgttagaccttcactcctttgaagtaatggctatatttgcctcatttttaatacgcagcacctaaagtaatgccaaaatatagtaggctctgtgtgtggaaaaaggtatacaataaagttcagagacttttcaaaaaataagacagcatcttgacagtccttgttcttcctaatattgggaggaagagagaataaggtcattgctttctggagtaaccgtccagtgactcatacaagctgaagtagaagcaaaagaaccatagctggttaacggtaactgcagcaagtgaaaaaggggacatagtatccaccatatatttattggaaacccatatactgtctaatttttataaatcattcattcatttataatcggtgcactcactttttaaattcaggtctasattcatttctttgccagtcaatacccatttaaccaccagatcctaattttttaacctctttaataataattacccttttctctacatccaaccctgtcactcccttactttagattctcttcatctctcacctgggttactgtaactcctaacttgactctyttcctctagatttgtccctgctattccttcttccttgccactgctgaagtaatacttaaaaatatcatcacagcacatctttgcctaaatcctataaaatratgtccaaacctctcagcatttagttttctaccatatagcacctgcttctctctttagatttaaatatcatacccccacatctttggttttacctcttcctcaagtctatatgcatatatacacacatagtcacagaacacacagataaacacataaatcacaaattattattcttgtttcaagaattgattaagagtttttctctttgtgaagtcttcatatttcagttcttggtcaaagcctatttgagccacctcttcctctgtgagtctactgtcctctgtgcccttactgccttttttttctttgagacagagtctcactctgtcacccaagctggagtgtagtggcgtgatctcagctcactgcaacctccacctcccaggttcaagagattatcatgcctcaacctcccgagtagctgggattacaggcatgctcctgttacattttaataattgtaactaatattcatatttatttgaacccagctctctttaccctgtttgttattctttctttacccttagtgaccacattttccaaaaccaaatgtagggacacagagcttagcaagtagcaaagtacttattaagaataatgagacaaggttgggcatggtggcttaggcctgtaatcccagcactttgggagtccgaggtgggtagattacttgaggtcagtatgagaacagcctggccaacatggtgaaagcccatctgtactgaaaacaacaacaacaacaacaacaacaacaaaaaatgccaggcgtggtggcaggctcctataatcctagctactttggaggctgaggcaggagaattgctttaacccaggaagcggaggttgtggtgagctgagaccgcaccagcgcactccagcctgggcgacagagcaagactccatctcaaaaaaaaaaaaaagaataatgagacaaagtatatgaaatggaaattaacccttcatgtttaggatggtcgtaactgatagatggaactracatttgtctggagctttctctatgctaagtgctgcaaagtccattatcttaaagtgtattaaaagcaagtggacaatttatttttcaaattttctgcagtttaaaaataataacttaagccrtaactgaaaaaagaaattaagtttggcatggaaacccttaaacgtgtgtgtttaattttaggaagatttgcartcaactaaagaagagagatttccagcgatccacaagtcrattgctattggctctcagccastgctcactgttgggacaacccacatatccaaattgacagatgaccaactcataaaagagtttcttagtggttcttactgctttcgtggggtgagaagtaaatcttcagtttamatatttattttacaactttacctgccagrtatggtcagtgggcatcagcagcactgaaaagaatttttctctagagaaatgacaggatcctttcatccccaaagaacattttctttttgcagtctcatacccccacgtttctgtaatctaatccatagcttttatgttctgtttatttcacaaggtaaaaatttgaccttttgtctggcaatcatatgtgattctggttgattgctagaatgagcatgtgattgtatatcccacattttggttatgtagcaatcacatttcaaactggaattaacatctccctttaaaaaaaaagttagagacagggtctcactgtgttacccaggctgatctcaaactcctgggctcaagcaatcatcctgcctcagcctcccaaagtgctgggattacaggcgtgagccaccgcacctggccaacatctccctttacaaagttaaaaattttgaccctgactcttagtactagtgggaaatacagttactagtggaatttttgttttattgtatttaaaattttaccaagacagtgcatattctctgtatttgtctttaatttctcagtaatgttttcttttaatattcaaccatactattgcttttacaggttttaaaaataacatgtatttccattactgtcatgtggcattattgagaaaggcccagttcttaacttgatctaatatgttttctttttttttagggtgtcggttggtggaaataygaattctgctatggcaaacatgtacatcaataccatgaggtatagaatagcatttatatatcattctaccactagatggtttaaagtttaagaatctgttgtagaaaaaaagggggaatggtataacttttaattatgagatgattttaatatgattagtataatcaaagtatctccaaattttggaaaatggaacatttggcattaaccaaatcggtaaccttaaagtgatattgcttattaattactcatatgcttctattactatgagcctagtagaataatgagctgttgtggctatacctcttttgctttgatcaagaaattaatcattcttacaacttatccttaaattaagaaaatgaattagccgggagtggtgccgcatgcctggaatcctagctactcaggaggctaaggtggcaggatcatttgagctcgggaggcrgaggaggttgcagtgagccaagatcacaacacagcactccagccagggtaacasagtgagactccatctcaaaaaataattaagaaaatgaggccgggcacagtggctcacgcctgtattcccagcactttgggaggccaaggtgggcggatcacctgaggtcaggagttcgagaccagcctggccaacatggtgaaaacccgtctctactactaaaaatacaaaaattagccaggtgcatgcctataattccatctactcaggaggctgaggcaggagaatcactggaacctgggaggcagaggttgcagtgagccgagatcacgccactgcattccagcttgagcaacagagcgagactctgtctcaaaaaagcgagactcctcaaaaaaccaaacaaacaaaaaaagaacgaaaataaatgataagatcatacattatcactagggttacaaaaattgggtaaatacagcaagtttctcagccaaaagaataagacaccctgggccaggcatagtggctcatgcctgtaatccaaacactttggggggccaaggcaggaggatcacttgaggccaggagttcaagagcagcctgggcaacatagcaaaaccccatctctacaaaaaattttaaaaattttaaaaaaagaaaataccatatcatctaagtttaaaataagttttaagattatactttttgagttcttttatttataattttataactcaccgtattctcccatacttgagccagcctgcttaaattctgaggttcaagttccaattctgttatttgtcctacttatactttgtttagtaaagtaagctgctaggtattgaagacaagctttaattaatgaatatggacctagctgctttaaaaggccattttcgttatctaaaaaagaaaataatacccaaaatagaaaagtgtatatttgcccactcataatgttttgaactgatctcagattccaagatagatcatactgggacagactgtcaattcaccttccacatttaaatcttccaaaatgaatgaggcatccatagactaggatgtgttcggtttttttgttttgttttgttttgtttttcacttaaacctgagaggtttcatttaagtattctttccatttattcctgctactttgcagatgtttgtttttttaataacaatacagaaaaaggataaagtaccattgaactacaacccttataatacctgatgagtttcttaattaaagaaatgtatgccagaaattttaaatgagaagtatctgtctcctctgccatcataccacttctcaaaaaagtttaactactgttaacattttcatagcctgccacaagaaaaaaaatgcatatatatagatcttggtataacttttttatttatagggaaggtatcatgcactgctctgccacttgttcttttcacttagtatcttggagattgctccacgtcagcaacaatcgatttcattcttttcagcagatacagaggattatgtctgtaccacagtgtatttaaccagaccagacctctgctaatggacctttaagttgtttccagtttttgctgtgatatgttttagtgaacatttttaaatagttctgttggtatacttttgtaagtatattcataagggacatttctattaacatacttccttggtcaaagtatctgcatactggaaaattgccttccagagttagaccagtttacactcccataaacagtggctacattcctatacacttgccaacactaggttttaccaaacgtattttagccaaggttgcataacctggaactttctagggaactctgttaggtgtttagagagatactaaaaataatagtaattagcaaaaagggtgcttactgtatgctaggcactatgtactttacacgtattaattcttttaatattcataacaaccttaagaagtggttattgttattccaagatgaggaaatagaaacaaaggttcaataacttgcctaaagtcaaataggtagtaactggggaaactggaattccaaccgaggcagtctggctccatatccaacctcttaaaacacttcactttgctgctctaatttctgcctatccaggaacttaatctagttgctaaaaacaaatgttgttagctatctcttacattaggcactaagctccactgggcattggccctgcttgtttcctttgccaccataggggttttttttgttttgttttgtttgagacagagttttcctcttattgctcaggctggagtgcaatggcgcaatcttggctcactgcaacctctgcctcccaggttcaagtgaytctcctgcctcagcctcccaagtagctggggttacaggcatgcgccagcacgcccggctaattttgtatttttagtagagtagyttctacatgttggtcaggccggtctcgaactcccgacctcaggtgatttcgcccacctcagcctcccaaaatggtgggattacaagtgtgagcctccgcgccccagccaggggtttttaattctactaaccagatatctattagtgcccagcatggttgtctggcatacactatgaagaaagaaaccaaaggaatgcaaggaggtaggaaggataaggaagaagaaagaaggaaggatttccacatataagacagtatatagttagtgtttaaaaaataataaaagcagaatgggaaaaggggtttctggacagacagttscaatagagaaataagtatggtaccaaatgaatagtgtaaagatcagtataacattgcgtaggatgaagtcaggctgcagtggaagagatagaggccaaagatgcaattaagaattgcagtagtatgtgatagtattatctaggtatgagagattaaactcttggttgtggggtgagttgctggcagtgaaaaagtagaggaagagtctaragctgaaaaatatccaggaaagaactgatgggacttayctgtagaagagaaaaagagatagaagagccgaaaataactacatttagagctagccttactaaaaattagttatgttattcagagaaacaaggaataaagaagataatgtgcttaaatttccactcattgaatttgactgacatcattacacctaaatatagatatccactgtgcagataaagactagcttacaagaaggtcaggtcatcagcataaatatctacttgatgatatcaagcacgcattatcacaaatttttttcccatattaggacaaggatagtgggaaaacctctgtggttgtcgggacatggaaccaagaagagcatattgaatgggctaagaagaatactgctagagcttatcatcttcaagacgatggtacccagacagtcaggtaaagattcactttacttgcctttggagctaattactacaatttctaaaactcaaaatattgaaaaacataaaaattcaaacatttaagtaaaatccctgtttagtttttttcaagggatatcttttaggttagttttcttttcttagggaagcaacacagtgtaatagttcagagcacagtccctggagtcrgactacctggattcaaatgctggctcatcacttcctaccttggagaaattacatcatcttttttatctctcacttttgttgtgtaatggtatttgcctcatatgattattgtgtcatttaagaggtaatttatgtaaaggagaatgcctggcaatagcatgcaataaacctgggctgccacccataacagtgggggtgataacattaatgagagtggcagtggtgttagtaactggctcaattctgtcagaactgagggtgttttttaaaaactacctcacatctcttttaggatatatgagtataccttgtcaaaacaccagtaagttaatctcatttcccaagaataactacgcattagcttttcttgcagactcttaactcagtatgttttcaattattccttcttgttccttcttgggtattaccttttccttcctaaaacagatgatttggattgttttcagagtgtactgacttttcgggctgataaaagtcaaagtcagccaaattaaaacatagacttttttttttttaatactttaagttttagggtacatgtgcacaatgtgcaggttagttacatatgtatacatgtgccatgctggtgtgctgcacccattaactcatcatttagcattaggtatatctcctaaagctatcttcccccctcccacagacatttaattattgtactaaacaaattgatttttcttatccttgtaggtatatgttttatgtgaaaacagtttgtggtatcatgtacaatatatgttgaagaatgagtgttagactggtaaaatgaagcttttctttggatcctgctcatttgagattgacagtttggcctaggctttgtcttctatactacagtgcctaacgaacagtattttaatgggagtagcttgatggaggacggaagcaaagaactgttttacaaaacaatatagtgggctagggaaattgataactttaaaacaatttttttaaaggaatctaaccaaaattatttgtatacaaataaataatatgcaagttgaaaataattattaactaagccagtatgaagtatctcttatattctctttatagaatccaagagaatgcctctgtgagataaccctaaaaatatttttttaaagaatattttatagtcaggtttttttttaactaatgcaaaactgatccctctaaccatcttctcaccctacccattacaattattctattagtgagattttagtttaataaaacttgtgtgtttctctgattcaggatggtgtcacatttttatggaaatggagatatttgtgatataactgacaaaccaagacaggtgactgtaaaactaaagtaagttagaccatcaaatcatgctgtatgcctttgtcttttaactgcttcctatggacaaaagttttatgtaaacagtataattatgaataattatgaaagtataccatttaaattattgataaaattatattaaatcatacagggtccacttgagtgggatttttaagagtacagttattaacagtgatcttactttaaatgatttggacagtaccttaaagtkctctctgttttaggtgcaaagaatcagattcacctcatgctgttactgtatatatgctagagcctcactcctgtcaatatattcttggggtaagttaaaaagaaaataatcaaaaattccattttgagccatgttttaatttttttttctttttttttttttttttttttgtttttttgagacggagtcttgctctgtggctcaggcagagtgccgtggcataatcttggctcactgcaacctctgcctcccaggttcaagcaattcttctgcctcagcctcccgagtaactgggattacaggcgcacaccaccacacccagctaatttttgtatttttagtagagacggggttccaccatgttggccaggctggtctcaaactcctgacctcaggtgatccacccacctcagcctcccaaagtgctgggattacaggtgtgagccaccacgcccggctgccatgttttaattttttgcattaagtttaggaaggaccttcagtagtctccaaggcttaatatggcccacataccactcatgtaatagttgacatggtttttcttgacattttttattgagatataatttacatgaaataaaatccacagatcttaagtgttgagcttgataagttttgacagttatatacacccatgtaactatcacccaaaacaagatatgtcactgcagaaagttctatcatactcccttccagtaaataccccttagccttgctcaaagatacccatttctgatttatgacattgtagattagttttgtctcttttttggattccacatgaatggaatcatatastgtataatatttctgtacctgaactctgactcagtgtaacacttttttttggtggtgttttgtttagttgattttttttctattgatacatagtatttgtatatgtttacaggttacatatgatactttgttacatccatagaatatgtagtgatccagtcagggtattcagaatattcatcaccataagcatttattgtttctatgtgttgagaacatttcaggtcctcacttctcaacacatcttaacagaggtctggacattaactctttgtatttgtattgcacatatttttttctctgtctgtggcttgcctattcatttttctttctttcttttttttaatagagatagggtctcaccatattggccatgctggtctcaaactcctggactcaagcaatcctcccacctttgcctcccaaagtgcagggattataggcatcggccactacacaggctggaatgcagtggcgcaatcttggctcactgcagcctctgcctcccaagtttaagcaattcttgtgcctcagccttccaagtagctgggactacaagcatgcaccaccgtgcctggctgatttttgggttttggttggtttttttttttttttttttgaaatggagtctcactctgtcacccaggctggagtgcagtggcatgatctcggctcactgcaacctccgcctcctgggttcaagcgattgtcctgcctcagcctcccgagtagctggtattacaggcatatatggtaccacgtccggctaatttttgtatttttagtagagacagtgtttcaccttgttggctagcctagtctygaactcctgacctcaagtaatctgcccgcctcggcctcccaaattgctgggattataggtgtgagccacccgcacccagccccattttcttattaatgtcttttggtgaatgaaaaatttttatttcatgaaattcaatttatcatttattcctctttaatagctaacgctttttgtgttctaagaaatttttctaccccaaaatcatgaaaatattctcctatatttccttctaaagactttatggttctacctttgattatctaatgcctaaatgtggttttctctgtatttatcttgcttggagttcactaagcttcttggatttgtgggttgatatattttatcaatttggggaaatttttggacattatctcctcaaagatttattctgctccattctttttctcctctatttctgatactccaataagacatgttagtataaaattgttccagaatctcagacactgctttattcccactttttttcctttgtttcgatttgggtcatttctgttaagctgtcttcaaacttgttaatttctctgctgtgcccagtccattgaatgaatttatcactgatgtattttttatctcttaacatttccacttggttctttttgttgttgttgttttttatttacttatttttttttttttgagacagagtctcgctctgtcacccaggctggagtgcagtagcgcaatcttggctcattgcaacctccacctcccgggttcaagttattctcctgcctcagcctccccagtagctgggactacaggcatgtcccaccacgcctggctaattttttgtatttttagtagagacggggtttcactatgttagccagaatggtctcgatcttctgccctcacgatccgcccgtctcggcctcccagagtgctgggattacaggcatgagccatcrtgcccagcctccacttggttcttttttatctctactgaaatttcctatctggtcatacatgttttcttcatcatgtttagtataattattataacatttgataatttcaacatctgttccatctttgggttacatttttctttacctttcattttaaatacacttaattattttgccataatgttctatcatttttgttgtataagagctatgtgttcctctcttactcctgtcctttgttccttttccctcccccgcttgtttaaaaatattttctccacctatctcatattctgtatggatgactaaaagttgtttttcaagaagcttaatttgtagaaataatgttggatgtttatctaaaacaaggactcatgcttctagcaaatataactacatgtatccattcagcagaatagtactgaaaagtattcagcttagcaactttttaatggctttgttgttcttctttaggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccmctttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcmcaatatttattttaaagtgaataaaatgtccmcaagcagtgttgtcatgtagtcaatggcagattattaaatttctttatttttttcattatcctgttgtacacattttaaacatacatatctgaacaagaacagaaaagggccataaaagtcttttcctcctttttagtagttctggccaaagacagtttaagaaaaggctaatataattgactcttttagggttatttatagattttagtaggaagcagcacatagagaaagagcatgaactttgaattcagacctaggtcaaaatcctttttttttctctctctctctctacccagagatggggctgctcaggctgctctgaacccctgggctcaagcagttttcccacctcagcctcccaaatagctgggactaccaggcacacaccaacaagaccagtgcaaaatcctgtctttaacttactgtgtacaagataggaaaaaccaaacacttatacccaatacagcacagaacacgaggtcaccaaaatgtgtggtttttcttcctcacgccagccaattttctgacaccagctgggtgtcctacaattcagttcaattctgatactcgtctacttggagttgacagcagaccccacaagtaaagggctcagttgcacaacactgcttccacttacttcagatgccaattgcaagtctgggcatctagtacttttgaccaaccagctataaatcaggggttccatgactcccttcttgggtttaataatttgctggaatgcctcacagaattaaaggaaacactttacttatgtttaccagtttatcataaaggatacaactcaggaatggccagatggaagagctgcataaggcaaggtatggcgggggtgggaggcaagggggtgcctgcagaccttctaggcttcctctgggcgtgccactctcccagcactaggttcgggaacctagaagctcatcagatcccaagagagtttatagagtttgattttcagatccccctccccctttctttccccgaggtcagtaggtggggctgaaagttccaaccagctatcaatcacttggtctttgtagtgagcagccccatcctgaggctatctaggggctccacctcagtaacctcattagcataaactctatccagcataaattatatgcagatagagatagggtgatcaaaaagggctccttaaaagtaacaagacactcccattacctgggaagttcctaaggttttaggaaccctgtgtcaagaacctgagacaaacacgaaatttcttactataccgcatactagctgtgtgatcctagacatgtcagcgaacgtctttgagcctctcttcctcttttgtggagagaatacttacttcataaaatggttgtatcagtgaatgaattttactgtgtgtaaaaagtcttgtccaatacttgataccagtatgttaacttccttttattgcgtctgtctcctgttaagaagatcaaagatcaaagccattaaaatacttttttttttgaggtggagtctcgctctgacaaccaggctggggtgcagtggtgcaatctcagctcaccacaacctctgcctcctgggttcaagcgattctcttgtctcggcctcctgagtagctgggattacaggcgtatgccaccatgcccggctagtttttgtatttttgtatagatggagtttcgccatgttggccaggctggtctcaaacccctgacctcaagtaatctgctttccttggcctcccataagtgctgggattacaggcataagccatcacaccaggccaaaattcatttctttaatgaattaaagaatcatatttattatatcaatgagttaaaataacataattaccctcatatttagtataggtgataggggagggagttaaaaattaggtcagtgccagaagatacgttgataatatttagaacaaactctctcttagaagagggggaaaaatgatcttttaaaaactgtactagaatagtctactagggaagattgttaaaaacagaattcattatttcaaaataaaaaagattttataagaacgagtcagccttctagttgagtacacacctagctactcaggctgacgctggaagatggcttgagcccaggagtttgaggctgtagtgcactatgtcacctgtgaatagccactgcattccagactgggcgacatggcgagacccagtctcaacaaaaaaatagttctctgtcttgactaacatagatcaaacttctttgagggtaggggctagtccaggtatctccatatctgttttaaatcttgagtcccctatcagtagtctgtgaagtctcatttgctctccagcttacttgctgctaactctgtgatacaatcattctgtataagcaggctgaattgctaacagggaagggaaatggctcagctataatatggcgatgcattttgagaagtctatctcgtgtctattgaagccggtgctatcccatacctaaaccagattctttttttttttgagatggagtctcactttgtcacccaggctggagtacagtggcacaatctcagctcactgcaacctccgcttcccaggttcaaacaattttcctgcttcaggctcctgagtagctgggattaaggcatgtgccgccacgtccagctaatttttgtatttttagtagagacagggtttcaccatgttggtcaggctggtctcgaactcctgaccttgtgatccgcccacctcggcctcccaaagtgctgggattacaggcatgagccactgctcccggccaaccaggttcttaagacagggcctaagaatctgtattttaaataaacatagcaagtgattctctttgttaaataaattctctagtgattgagaattgctgatggggacttcactaactactagccctcctgtctccaggtgagggtttcagggaaataattagtagttcatctttacaagaaggttgtgacatggaaacttttgttggggttttgtttttgttttttttctgctttttaaaattttacctcttttctttgagaggctactaggtggggcttgtagcccagccctagtttgtttgtttgtttatttacttatttgagagacggtctcactctgttgcccaggctggaatgcagtggcacggtcatggctcactgcagcctcgacctcttggcctcaagggatcctcctgcctctgcctcctgagtaggtgggactacaggcatgcaccaccacacttggctaatttttaaatttttgtagagacaaggtctccctacgttgcccaggctggtcttgaacttttgggcttaagcgatcctcctgcctttgcctcccaaagtgctgggattacaggggcgagccactgcactggcccctagtttataatccttgattaaagggacactggcaacaaactttctcaaaattgaatagttatgttttgtgtactatcccctatgaactatccttttcaatcagtctgctacccaaagacctaacctggtttctgacaatacttaagtacgtaaggtttatgtacctaaacctagtacataatcagaccaaattattgacccagcagcaccaaagatctagcattaaaggacttaagctaaacaagaaaataaagttaagactaaattttgaataattaggttttggaatcagagcttcaaatgaaaatacatatcagctaccctagaatgatttttttagaggcagtgtctcactcttttgcacacgctggagtgcagtggtgcaatcccagctcactgcagcctcaaactcctgtgctcaagcaatcttccaccctcagcttcccaagtagttgggactgcaggcatgcaccaccacgctggcctcctagaatgatttcaaactcttcctagtgttgggcgattttattaccagtgcttgccatggtggcatggcttagaagaaaatccatttctttttctttttttcttttgttgttgttgtttttgttgacctgcttcctttctgacctgggctgattcacccttcttgagcaatctggtggtccctggctccccattgccatagcacactaaggcccagaacttgtgggctcaagccatcctccagctgcagcctcttgggaactcaagatgggcatcaccatgctggctctctttttctcacttgtttagcaggggaggtaaggaacccactgcacactcaagagcatgttttatctcatatgctgatagtctcaaacgtggtttcagcaagcaggcaagatgatgcattgggttgtaggaagaacatattagaaattctatttttcatctgtgaaagatgttaagcctcactaatatataatatgtggtacacacaataattcataaatgagaaagtcttatgtcataaagcatcctaagagtcggtgatacacatttggaggagatgatggggatacccttctttatttttcacttttatcctgttacaggatcatagactaaattaattacctttcagaaaatggaattgttaatctaaatgtaagccttaagatcatatcttgtccgggcacggtggctcacgcctgtaatcccagcactttgggaggccaaggcaggccgatcacttgaggttatgagttcgagacctgcctggccaacatagtgaaaccccgtctctactaaaaatacaaaaattagccaggcatggtggcgcacgcctgtagtcccagctactcgggggactgaggcaggagaaacacttgaacctgggaggcagagcttgcagtgagctgagatcacgccactgcactccagcctgggcgacagagcaagactccatctccaaaaaaaaaaagaaaaaaaagattttacctgatcaggtagataaccaatcagaattatgatgtggaggttaaaaggtgactttcaccagccatggttctaatcactgaggttcttagatcgtgcaagacttcttttttagaaataatacagtaatgccctctgctgggcacagtggctcacaccactttgggagccgaggcactttgggaggccgaggcaggcagatcacctgaggtcgggagttcgagaccggcctgaccaacatggtgaaactccatctctactaaaaataaaaaattagccaggcatggtggtgcatgcctataatcccagctactcaggaggctgaggcaggagaatcacttgaacccgggaggcagaggttgcggcaagccgagatcgggccattgcactccagcctgggcaacaagagcgaaactccatctcaaaaaaaaaaaaagaaagaaaaagaaataacacagtaatgtcttttttacagttatgggaaagaatggcatgttttcctggttagcagccattagagcctacagtttgaagactactagaattccactttttaatacgtggagaaaataaaggcaagcctgacagtctcaaaattaaagtggaaagaaaagcaaaattattaacaaataaaatacagagcttgaagtatcttgcatccacaactatttgtaattttggggttttttttgttttgttttgttttttttgagacggagttttgctctttttgcccaggctggagtgcaatggccccatctcggcttgccgcaaactctgcctcccgggttcaagtgattctcctgcctcagcctctggagtagctgggattacaggcatgcgccaccacgccaggctaattttgtatttttagtagagacgggttttgtcatgttagtcaggctggtctcaaactcctgacctcacgtgatctgcctacccctgcctcccaaagtgctaggattacaggcgtgagccaccgcgtccggccgctatttgtaaatttttaagcattttagtattttttacacttgaaacaaaaaatgttcaccaaaagcaagtaaatcaagcaggacttttggaaacagcaaccaactcaattaccaaagatgtttgtaaaactaaaatagtgctaaagagctcacatctaatcacatactacattatgtgtttcaaatctattttaattttttttcaatcctttgccactacagacaatgccacactaaataataatctttgcatgtcgtttaacctttttgctagtatccttgaaatagatactttttaaatgttttttatagagagggagtcttgctatgttggtcaggttagttttgaactcctggcctcaagcaatcctcctgcctcagcctcccaaagtggtaggattgcaggtgcccagccttctaggaccttttgatagaaagaattgtgctttgtcttgaatttaagaaaaaatacaacatagcttcctatatattttcctcaagtacaaacataacttttattttataaatatatattaaaaaataaatttacttaaaagtccagcagtgtggccggctgtggtggctcacgcctgtaatcctagcattttaggaggcccatgcaggaggattgcttgagcccaggagtt

SEQ ID NO: 12458 - DNA, 13833 bp, Homo sapiens
tccaaatttgggcaactctttaaaaaagaaaaggcctctaaatctggttattaacccagaaaaccctgtggggtcagggaagtggtgatgagagtatgcctctgtaccagggtgctttgtgacaccacttagacatgaagcaaagtgtggccaaggtgacattcagaaaactcaggatccccactgacaaaggcactacctctgccctcctgaacctcctagcacttttatggccacaggagagcagctgagctgcaaagaaaattccccatccctttcctgaggttggagatgtagcaaaggctcttctaatgaatggcagggaatggggacatctgaaaacaggtggcacaagctcaggaagcaagaccttcagtcttcatctttttctgttccctttcatgacatttttcatctcttctttgtttagcgtagtgatgacatcattattgtgctcaaataaatcccctctgccctgaattgtaatggtcattaactccttttcccaatctcaataggttcccctttaaagcctatagcctggcaagtcctgggttggtggtggctggtcacagaattaatgaatatgttctacttattatgggccatgcagccctgttatctcttaaataaaagctgcttgcattgactcaggaaaagctgacttcctcttgtccttctgcacagatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgagtcttttaaccctgaaacaaatagaataatatacaagccctggccagatttcttttaggaactaaggtaagattcttaggttcctattccattagtgcggcatgtattaagagagtatatttcacaaccagatatagagccacatggggaggggcagccagactcccccaggatgctgacatggctgtcaaagacagcagagacttgtgtttggtacagtttagcagttgtcaacgggtgatttgacccccacgggacatttggcaatgtttgcatatattttttattgtgacaatgttggggtgggggaggaagtgctactagcatctaacacgtagaagccactaaacattcaacaatgcacaggatagcatggtacaacaaacaattatccagccccaagtgtcactagtgcctcggcaatgataccctactgtagttgaataaacactgagtggagtggagagtttggctcaagcttttccatgcacctctggataatccagaacaatactcatctggaaatacagaatagtacatgattcctaaattcctaactacaattgtactttatggagtgcctatcattcattttcatagagatacctgtgtaccttgctatttttttttttttttttttttttggagacaggagctctctctgttgcccaggctggagtgtagtggcacactcatggttcactgcagcctcaacctgctgagctcaagcgatcctcccacctcagcctccctagtagctgggattacaggcatgcaccatcacacccagctaatttctgtatttttttgtagagacagggttttgccatgttgcctaggctggtctcaaactcctgggctcaagcaatcctcctgtcttggcctcccaaagtgctggtactcacaggcgtgggccacgtctggccctaccttattactttttaactacccattctgctttaggccttctgttatttggtggttcatgaatccatgaactgcacaatgatgatggtattataactgagcttccccgtaatgatgtaaaaaacaaaggtcattcctattttccagttagagccactttgtaagttagattaagtacaattcacattccccaagtttctaatttcacaaagtagagcatgttgttttcataaagattgaagagtttgggggacttaaaatagagttcccctttgcatttttgtaccttgtctttttctggtgataacatatgtttgagaattataggtcatgagaaaaggctcaaataacatgtatgtataaacatgcttaaaataaatgtgtataaaggcttctttttctaaacatgtcttataaaacttagctatgaagtaaaatgtaccagactgataaaaagactccaaactccaaagaaaataaaattaaatcaatatgtggcacaataggtaccccgtcttctcagctagctacccccaaaactcttgaaccgatgcagtaataggcaggttcttttccttgaagcaaggggattaaagtacatggagagcagggttcagtccattgtccaaaagtccaacccactcggctcattgaggagggccttgtgtagattttgaagtacacactagttcatcatctgtgtggtatgccctttcaaaggactggaagacagtcaaaattaaaattagaaccctactaaccagagtttattttgttattatttcttttctgaaacttcttggggacttgtagctcagagctgtgttacaacccccattaccacacccagagatatgtggcctgggagttagtagagtcaggtgcctttatgccatgttttgccatattctctgcatttctcaaaaacaaaaacaaaaaaccccacaacatagcaaatgctccataaatgttaaaattctttttcaaaggaatgaaggacagcacaaattgcaatttgtgatggagtttcagtctctcacaaatgttgcctagacattcgccttgtatgagaacctgaaggaactgagtttttcattcatatgctgggggaggcatcacctcactgaaaatcaattccctactatccttgttgatgtcagggaaattatgtcatctctcagagaaacagtacaaaaaattaagatttagtatgtggaactgagattgtaaaactacaatcaattcagagtgttttgtttttgttctctttattccttacattgcttactgttagaatggaagttacagttgctgttttcagatggctgtcctgaatctataaggtagccccctgaatgacagataagtcactctgaccgcctttttttttctctcccacttctggacctctgcaggtgtctggttgagaagggagatgtggcctttgtgaaacaccagactgtcccacagaacactgggggtaagtgcacctgctcctctgtccccctagatcactagatcctggtcactggtattcacttgtattcagggatgcctttgtggaagtattatgtacactgtcagacttcaaagctctgattctcagtctgtctgctcagtgaagagagacatgttcacctgagtgcacagaatgatcaggattatggggcccccaatggccctaaatcctccccaacacacactcccacagctgcaagccttgtgctcctttcccctaaatacttcagtgcctatttcctaagaataagacaatctcttgcatacccacagtatgattaccaagatcaggatcttttacattatgtggatttaatactcgtcacgtccacagtccacatttaactgttgtcagttatcccagtaatgccttttatagctatttactgtacttctgggttgtgtccattgagaaggcctagaggcaatggcataccagcaggagtaagcaccaagatattggcttgtaagtactcttctttactaaaaggaaccagaactccttggaaaaatagctgacttcagggctggggcaggaaaaatagatgctgagcctagaacaacacactgaagtgctcaaacagtgatgggacactcaaagcatacaagaaccaatttgaaggatctcctgttgccaagtctgggaattttgagcattaaaataaataatgatagcagtaagggataatagcccattgaaagaaataagaatgcatgaggcaatactgattaaacaaatgaagaagggaaaactaatcaatgtggaaggaatgatagagttagaaaactatcacttggcaaccaatatattgataactgattcaagcaagaatcaatgggtgttaagccgggcgcggtggctcacgcctgtaatcccagcactttgggaggccgaggcgggtggatcatgaggtcaggagatcgagaccatcctggccaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagaatcaatgggtgttaacttgtgggtgaacgttggacagccataatattaataaaaacaaacaaaacaaagcaaaacaaacattggccagactgagcactccacacctgacccctcagtatcactaagtgctagcagagcccactggaattcaagctgtgaatacttccctgccttctctcatgttcattccccaactcctcacttttcctgggcaactcatccagaatgaaccggctcagcaccagcccctccaggaagccttcccagatggcataccctgtcctacaagaagactcctctgttcatattgccattatgattgaattcaccacactctgtaatacactttggctacagaaactctttgagctctttttcttcatcttatattcccagaacctagtgtagcacatagtacacagcagttgctaagaatttgtttgcagaaatattgggttgactaattttcctttcttccctcgtattattgctttttcctttaagagagtgttaccctaagcttggctctttgccacccttgatttcttttggtacttttctgagtagagctcccttctttaagctttgactctcttactctttgcaatgactcaaaaattcttccctcctgcatagaattaagataggaggcctgacatccaatctcaattccattccagtctatttcccaaggtgtcacttttatgtagagagtacattggcattgcaattgtatttttttacgtgtgtatatggatgtcctcatatattgtagttgtatatatacaatccatatacaactcaactgtcctcatctttctgtcaacgttccctcctcttctcccagcctctatccttatagagaatcctgctatactccctgcccatcaggcctagattaagtctgtcagtcaatatcttatttcttcaaaacgtgtcttttttcaaactaaattttattgtgtgtatttaaggtagacaacatgatttttaagagccaaagtaattttgatgtattgtaagtttgggaactactggtctaatacccctgacttaatatcacattcctgataaatattactaaatgtaagtcacatcatgtctgattcatcatacttatattttgcaccttcttaccttcttctgttattaatttgttgctttttcaacttatattttagattgagggtacatatgcaggtttgttacatggtatactgcatgatgctgaggtttgcggtatgattgaacctgtcacccaggtagtgagcatagcacacaacaggtagcttttcaactcttgcccccctctctccctcctccaaaatctgtcttaagtgctatggtatatacaagaaggaagacacaaaaccacgtgggctttttttttttcttttttttctttttgagatggagtctcactttgttgctaggctggagtgcagtgatgtgatctcagctcactgcaacctccgcctcccagatttaagtgattctcctgcctcagcctcccaagtagctgggactacaggcgtgcaccaccacgaccagctaatttttgtatttttagtagagacggggtttcaccatgttggccaggatggtctccatctcttggcctcatgatccgcccacctcggcctctcaaaagtgctgggattacaggtgtgacccaccgcgctcagcccacatgggctcttttatcacaatttgtgtgkgtgtgtgtgtgtgtgtgtgtgtgtatgtgcatattataggtgtgtgtaggaaaaagaatgttagaaatgtaccaattttgaaggcgtagactatgaaattacaaatgcttcaaaattttcttcccaatacttacgtggcattttataaatttccaccaataaacgtgtattatttttattgaaaaagcatatttttaacatgcccttctagatgccctcctagccagactgaatcacctcccatttgatttttcttaattttctacctttaggttctggctcattcattaacatcaatttccattcataagtcctcacaaacccacttttcctcttgcctgagtgcctcacataccctactgcctgagatggttccagaggcggtctcctctctcccttagaaacaccaggcacacacctgcccccagtctcgcctgcactctcctttcctcccgcagagaggcattcctttctcctcctctcatcctacacacactataagagacaactgaaatcttgcctcctccagccagcttcttaattcatttgttctcaaagccctggtttgagctcacacagcatctagagtgttttacaaaatataaaatattattatccctgccctgaattttttgttttggtatgtgtgttattttcccctccaataagattgtgccttggagagggctgagaacatagtatcatagataaatgaataaaataacataaaataaaataaaaatacatataccctttgaactaactattccacttctatgtaagcacaattatatgccagtaacactcattttaacgctactttagtggcaaaaaattgtaaacacctcagatgcctattaaaagaggaatggtttaaagatactattatagccacactatgaaatataatacagtagttaagaagaacgagcttgatttgtatgtactgacaagaagaatctataaggtatgtaaacagttgaaaaaaaagctacagagttttacatttgtcaagatctaacactaaacaaaattagaaacatgtgaaatccatatacacacgtagaaaaatacatataatgagccgtggatggaaactcgcaaatgtgatattaaagactagcactataagactgagtgagatttggagagtataggaaaggaggcttttagttaatatagagagatattcaaaaatttatgagtgtgatctcatgtattagttattcggttaaagaaacaaaattaaatgaaaaatacatttttaaaaaggttgcaattctgaattatgggagagaaataaaaattagcaaaacatatttgcaaagtggctcaggaggaaggagctgaaaccctaagaatgggtgagtttttttttttttcagagacaatacagaaaagaagaggcaaaggggccgagatgggatacagacctgtatcacacaggtgtgtgcacattctcatttagaactggaacaagggagtcagayttaaaattctggtgcagattccaaaggtgttctctgaggaaaagttcttttgtttggagatgccatgtgttacagcacagaaattgatcaacctggcttagagcgtcacattcttcctctgttggagcaagaggtacagaaggaattggaatttagtggaattgaagatctttttgaacagcatctgcagaatgtagttcattctcacctggctgggtagggaaggttggaaggggatggtcaataatcattcctggtcactgtgagtctggcatcaccttgtagaccacatgggtgtctcttcctgtccacatcactgtaaccccagtgtgggcacttctgctggcgagaaggcccaggttctctacacaccactgagtcagttccatctccccagcggggcaccttgaccaaagccatcagctgaaccaccttcttcctgtccctaggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcaggtatggaccagccaggtcctcccaccttttcttcctagatggccataggctattcggggggagtttacaacaaagtgcagccatgactccagcactttctttttgaaaactagaattccatgcattgtgcatttcatgccatgcattgtggactagagtatcagggttcaaatcacagctccacagcttcctagttgtgccatcttgggtatgttacataacctctctatgcctcagcttcctcatatataaaattgtaataataatatttttacctacttctcagttaacatgagtattaagtgaagacatgcacccaaacggcataggaaaattccatttcctataggacgtgctcaaaatatgttagctgtgtaattatggaactagacctctcaggcccagctctgcttctagctcctggtcactggtgattagatctgatccatgtactcttgggactaggaatctgcctttctgctccccctaaccttgttcaggggtaccctcatttcccctactcctgtccttcccgaaaatgaagaagacagctcctgtttcccagcgcttgttgatacgagtcatgaagagtggatttctgttcctcttgcctaggcagactgagcactgttctcaacagtctgaaaaacacaggacccttgccctcggagagcctgccctctgggggaacaaccactcagggccagccttgttgaagacaggggctgcctgagtattctaatcctaaaggcccctccacacacacacatcaccttccttttgggcatagctgcctgctgttgattcaccattacctttttttaaaaaaaataagagtatatttgaagtccttttaaggtacatgacaataataagcatttaacatacatttcctagctgctatatggaaagttcaacattttgcagtcatcatttcacttacaacctttggagatctggagaagctgagtggcttgcccaagaaaggattcaaaatgcagtcaaacatgaacttttaagaactacctctgccactcctctgggagggttcacatttaacatcttctttgacaataacatctgaagggacatgttattgtcctctcatttcctataagcagcccccagtgaagggcaatgaagtggggaagagaggtcagagtaggcaggcatgggtgtgggtgggagggacttatcagaggaaggtgggaacagggaccctatagatgattttgggggcatcatgaaagcatgcagctggggccctaagtggataaatggcagataaaggaggtggaaaattcccaagacatactccgtagcttccctttttccccagggctggttcagagctttcagactcttctcatccatgtgttcccagctgctaaagaccacaaggtcctcacggactttctgttcacttgacagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatgtgagtaggaggaacagcatggggaagtggcaaccaaacatggtggtgagtgctgggatggtgggtgggtacaggaggggtaggctgtggcccttgggataggacaacatggacaaaatgaaatggtgagtgaacaatctaagcccggcatgtatgacaggctagactgtaggggcagatagtaaggggatacaggctcagagcactaaggtagtgaacttattgggtatagagaattccatcttatttctaagaaaaggactgggtttatgtgtacatgccattgctctgcagtaaacttttgattagagttgccttgtccaatatggtagccaccagcaagatgtgactatttaaatttaagttaattaaaattaaactaaataaaagatgtatttcttcaatcccacctagctgcatttcaagtgctcaacagccacatgtggctccatattggtcagcaaagagaacgtttgcatcatcacagaaagctctttcagacagtgctgctctagacagcttcaacaatgataggttctggtaaccataaagttgctatgcatactactcatttggaacaccagtttctgagaactgaaatagaataaaacacatctttgcagtataactatgttgggtgtaactgagtcacctgaaaaagtttggaagctggggaataacatgtggtgtagggcagttagtctttccacaggagtatgcagataagggagtcttgatccttattaaaatgctgattctcagagccttgagatactgatttagaaagtctgtgctaggtcaggtatccgcatttgaaaagctgcccccatgtaattctgacggaagcagcaatgtgcttgtctaggttcgctattgtgagaatcaagttgatatttacctaacctatatcctccacaaaagcagacagtctggctctgctcttctttcctccatccttagcccacagcacagaaactggcacattgcaggtgctttttgctatgtcagttcctcacctgcttaaagaggtcagggaggacagtcttcctgggcgactcctggcctcaggaactcagatgtgtgagcctcgcccataagaaacaaggtggaggaccctgtagggcaggaaaatcatgttaacagctttggcgtggggcactccccaggataggcacaggagctgtgcaggcaagtagaaaagagcactgggagaacggcccagttcacagaagaggaggcagcaagtctgcacactttgtactatgctgaaattgttcaatcactcgacagttcagaaataaatataggaagattttgaaaatcctacctctctgctctgctccacagcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgtatactggtgtgtgtgtgcacgtgcgcgtgcgtgtgtcatgctaaggaaggggcaagaaggaggatgcagagtgagttacagagatcaagtactcaagtgagtacagaaagactacagaagacttacctttatttggtattttaaatgaattccatcaggctgaggtcctgattctaactagctgaaaaaagtgaaacactgacatcttttttgctgaaaagcattccctgagcttgatgccacagcagttactgccctgtctcctgcccttctcagcccagcttcctgtaaggtggaggctgacttttctgtctcacttattattggctgaacatacagaatttggtcttctgcttcaccaacttacctgaatgtaccctggcaaaagtcaccgtctacctgccaactgttaaaccaattcaggtcttccattcctgagcccatttcctgcagttgataaagttgaccactccctcctccttggaactcttttcctcagtttctctgacatggcaggtctctgctttgattcctacctctctctgttcatttgtagtcttcactgtgggctcatcctactggcctggaaaccttagggaaatcttcctggggttttctcttgatctggtcagtgctcctctcactttgcaggccctccttcagtgatgctcatgactcctaggcatctgtatctatagctgtgaccccagcctccagcagtatccctgcacttatacatcctactacctacctgtgggtctatactcgagtcttgcagcagtcagaaacccaacaaatcaaaaattgaagtgatcatcctgttcttctctctcttgcttccctaaaccaactgttgttatagtatattccatatcagctgaagacctggtcatctacccaatcacataagccataaatagaggggtgaaatttcagttcgccattttccctcacactacatccagcgtcaccaagttctgttgattttgctttctaaataacttcagttggctcctttcttttcctgactcctaacacagcctcatcttatactcaaatacagaagtgcagataaggggtatctggacacaacattccacacctctctcaactgtctagtattcaagaaaataggactctgggtccactttgcagtccagacctgatatggaccgttttacacacagccctgctttcctctgagcctatcaacgatctgccttatttaatattaacctaaacttaccccaaatcctataactctgccttttcctttgtttggtgagataccccatggctcccctgggacgcagtctgtctcattgcaatggatcaataaacctaattttattacactacaggtatattcctggaagtcttagacaactgggctaaaacaaaaatattcaacatccattcttaattattaaattagttactaaaataggatagacagatgttatttggccataattttatatacatgtaaacaaaagctaatacatacctaatgatgaagaaacagaagcattcctactaaagttaggaacatgaaaaaaattgattactatctatcttattttacagtgttttagaacaggtggccaatccaattatacaagaaaaataagttataatatttaaagaaatgccaaaattacttttatttgtaagtgattatacacctaggaaatccatgagaaccaaataataataaagtattatggccaggcgcagtggttcatgcctataatcccagcattttgggaggctgaggtgggtggatcacctgaggtcaggagttcaagaccagcctggccaacatggcgaaaccccatctcttctaaaaatacaaaaattagcctggtttggtggcacacacctgtagtcccagctactcaggaggctgaagcatgagaagtgcttgatcctgggaggcagaggttgcagtgagccaaggtcgcaccagagcactccagcctagtgacagagcaagactctgtctggaaaataataaaaataataataataggcagggcgtggtggctcacacctgtaatctcagcactttgggaggccaagtcgggcggatcacctgaggtcaggagttcgagaccagcttgacaacatggagaaactccatctctacttaaaataaaaattagccgggcg

SEQ ID NO: 12459 - DNA, 33556 bp, Homo sapiens
ctccaggcagtgtctgggccctcagctccccctccctccacctaccccctcacacccaccactacgaccccacgggatacccagcccagacggaggaaacaccgagcctagagacatgagagttggaggagcattccaccttctactcgtgtgcctgagcccaggtacggggctgggcagggggcagggtagccagcatgaggctaggtgggaaggaaaggggcagcaagggctcacagtggagcctggggctgcctgagttgcctggcagggtgctgcccacccttgccctgctgcagccgggtgtgggtattaccaggggacctttccccaggagaccctgtgcctgatgttcagggtgtgtgtctgtagtgcagaggtctttgagtggatctttatatgtcccctgtcgggctcacacatgtgtgcaggtgccctgcaagctcatgccgtgactaggaggagagggattgattgctctgcaggagctggaggtggggtaggagaggggtaagcacgggcattgggtgagggctcaggaggagcttgggaaggatcaattttcatcagactgtgtgctattcccaacgctactccttctctcccaaggccagggccaaggggcagggaagtcacttgccttgaaagggcaagagactaagtctggtgtaagtctgagtggtttcttccatcatggccagtgacagctcaggcctgagacctcagccttgggccccctgtgctatgacagggcagtgccccactctaggatgaggcctgagggtggtggggatggcaactccagagacttctcaccccaccaggacaggtccacagggcagggctcaagtttggacattgtggcttcctgcccaggttggggcaagttccaccaaggggcattctatgccaacatcactggaaagggctccgagtccctcttgcagtctggatttgggatgaaggggcatgaaggaggaatttgggaaggcggggtgacattttcagcctttgtgtgagcgtgaatgtgtatgtgagtgtgtgggtgcgtgcacccgcatgggaatgatgacatttccggcaggatagctgcagcccttctctgtctgatgagagcagggctggcagagtccactcgggaggctccagctgtgctgtggggacccggacttccccctgtgtggtgtgtcaatgggtgtgtgaggacaactcagcactggctgcattaacgcatcaataccctcagctggagccgccttttctcccctcccttacctccagagggaagatcaggagttctggaagcaccttgaagattcagaaagaatttgcaagcagagagtaggcaccactattgagatgacaccccgtaaagcatggccagtttctggtgcttttggggggcaaagaatcaccactgtcctcttccttggagagcccatgtgattcctccattcctgtctctcctcaagtctcccatccagctctctcttccactttgcctttcttccctctctccagcctctcctctcacattccctgtagtacttccttagtgctacagcaagaggaatcaaggtgagacattaggagcaacttcccaaggagagggaggggtgcggaaaggctggaacccttgggaggaggttgagaagacttctaaggagatagaaaagctgggtgaggctccctggtctgggacaattgaagaatctctcagcctggtgcagggtggaggtgcttttcttgcagcctgtcgctccttcccaagcccctctccctgaatgcttaccatcctgcctggcaggctcctatggcatggagagagtccttcctgtgtgggtgcttccagcggtgcttctccagggtggagcctctgctctcagccgagttctggctcatccctggcttgccttgagcagcctcaggatctggcagatggcagcaggatccttatctcaggaatgagctgttgttctcttggcctggagctggaagaggcatcactaggtcccgttagagccccagcagtcagcctgcctgctctgggtcaccttggagtctagctgggttatgacagagctgatggcccagccagtgttcctaggggggatgttcagggatccctgagctgttgagggtgttgaaagggcccttgctggcctctctggagccaggctaagccttcctggcagggcttccatagatatgtctggtcttgaatgaacacatacagggactatatgaacacacggtgggtgtgtcttttgaattaatatgttctgtgtttgtgtgcagattgtgtctgtgtctgaatgaatctatatagtgtctgtgtttgtaggaaggtggggccatataggtatgtatctgcattttgaagccttgtaagagtgggccacgtgccgatttgtttgcctgtgatggtgtaattgtgtgtgtgcatgtgtgagatctctatgtgtaaacatggtcctgagccacatgatagaacagaatgattgctgagacctggggctgtgactccagaagacatgttgactcaaaaaagaacgcagacggagagtgtgtgaggcctggtgaggggcctgcagaggcagggttgctggagactgggaggtggagggcagagtgtccagggtggggccctggctacaccccccggtcttatccctctctaggtccaaccggttggggataggcctgcctggggcttcagggtagggagggacaagagctcagtcctgagctcctgggtcctgggatcctggctcctcacccaggattgcctgccactgactcagtggcaggaggggcctcactggaagccagcttgtgggggcagctgcatgcgagccacacaatcacataagaggaagcacacacagtacgcaatgctgtgtagtcaagaaagactcacaatgtcctacagatacctgtggccatagtcccaggcacacaccatcactcactatcacacacgaacacagccaggctcctggtcacagctgtccactgtcatgcacaagcacacactgtcacttttaagcacttacatagctcacatggtcacacatcactatacaaaaccacacagaggcatacagccacagactcacactgtcatacacagacacacatagacacacttagtctttggcttctcaggctggagaggagtcccagaagccattgtaaccaccccgctgcctctggacaggaggacttcactcagcccagacagagcccacataggtgacatttaatcagccaggctcttctatcagagcatttaacaactctgtgtgtaccacatgccttcacacacacaaacacatccacactatcatataaatatataagcagacacgctacgtggtcatgtacatgaatatcctcacagtacacataagcagccacaaatactcataagcatacaatgtacatacgtgtacatattcatacatgcatacacataatcatatatacatacaagcatacataacagctacatatataacagctatatgtatagctgttatatgcctgtgacaattcatgcacacacacatacacacccactacgagcagccctcctttttatgaaagcactgctgacctctgggtgccgtggacagagaatatgaagggaagggctgacactgactcctcctgaagccttgcttctgctcctaccaccccatcttctctgccctccccctagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtggtgagtgctgggcacaggggtctccttcctctaggcttcatgatgtctacctgttggacagccaacatcccaaagggagaagactgaccttgaacctcccccaaggcctttcagggaatgaggcaatggggatgagagctctgcaattgtgaattaagctagccagtcagtctacctcctcccatcccattctaaaaggaagataagttgtagtctttgccttcaaaaagttcccagtctgaccatatatctttccaagtgcttgatctcacctgatctcaccagttctgtaagaggtcagtggctcaggcatcattattctcattttttcagctgagaaaagagtctcagagaagttcagtgaattgcccaaagcagccaatccacatggcccttcttggctctgcctgtttcaccacctgttttcctctcctcttcacagttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaaggtatggccagactcctctaagctcctctccccctggcttaagagccaagggcagcttggccactttgagcctggctctgtctcttggctgggccctggcttacaattgtctgcctccttgcagcacgacctgcagtgcccatgtgctggacagagggccacatgacatatggcaacgatgtggtgctgaagtgctatgccagtgggggctcccagcccctctcctacaagtgggccaagatcagtgggcaccattacccctatcgagctgggtcttacacctcccagcacagctaccactcagagctgtcctaccaggagtccttccacagctccataaaccaaggtgagagggccctggatgagggcagtcgggggtgagtggaagatcagggactctgggacctgttggggtttccttgggttatcagtgccatcaaatcaaacctggaatccctgtgggagaccctccctctgggcctgccccagcagctgctatttttttttttttttttgagacagagtttcgctcttgttgcccaagctggagggcaatggcatgatctcggctcactgcaacctctgcctcccgggttcaagcgattctcctgcctctgcctcccgagtagctgggattacaggcatgcaccaccgcacccggctaattttttgtatttttagtagaaacggggttttaccatgttagccaggctggtctcaaactcctgacctcaggcgatccgcccgccttggcctcccaaagcgctaggattacaggcgtgagccaccgtgcctggcccagcagctgctattgagagcagatgataaggcaaatgtggagagtcagtcaaaagtactatggcgaatttggagggagcctggtctcagacagagctgggcttgaatcctggctgggacactgactggctccaagtttaaggcaagtggcttaccctccctgtgccttaatttcttcatatatggaaagggaatactaacatatacctttcatgggcatgcaaggattaaatgggggaggtgtgtaaagctcctagtacatagagaagctgaaaatattcagtcaaacaaagaataatagagctaggagggaccttagagttcctcttcccctggcttctcctgtcctcactgtacaaaggaggagaccaaggctcagagagcgtacatatttccctaaggtcagagtgaattaatggtgtccctgtcttgctgctgggagagaggtcctttcttgcatctctttcacagcagggggaaggtgactcacctggagagtggagtgtgtgtgtgtgtgtgtgggtgtgggtgtacacacatgcataagccttcccttcttctagagtgggtgtcccatcccccaccccacagggactgaggttggggtgggagctctcagagaccaggcctctctccacttcactttcaggcctgaacaatggggacctggtgttgaaggatatctccagagcagatgatgggctgtatcagtgcacagtggccaacaacgtgggctacagtgtttgtgtggtggaggtgaaggtctcaggtaggtgcagcagtcttgagggctgggtggttgggagggttgaactggaggaggctgggctctggtttggagcctcagctgcttctgcctttccactgccatccatttgccagtgggggctcccagcccctttcctacaagtgggccaagatcagtgggtacgatcttgaccctattgagctgggtcaagctcgcccagcacagcttccactctgagctctagagcccagagcagctggaagccctgggagaagcatgctgacacraggggttaacttgcatctccccatatcttccccactgggtgttccagggctaagagaccccctgggtccctctccctctttcccattaacccctgacctggcacctcctggtgctgttccctcaggcacctgccaggctgtgagaaagcctgacctgcctccacttctctccacagactcccggcgtataggcgtgatcatcggcatcgtcctgggctctctgctcgcgctgggctgcctggccgtaggcatctgggggctcgtctgctgctgctgcgggggctccggggctggcggcgcccgcggtgccttcggctacggcaacggcggcggggtcggcggaggggcctgcggcgacttggctagtgagatcaggtaaaacctgatgcatgctgcatgctgctgtgcggcagggaaccggcgccctgcccacctcactcctgcctgccaccggccggctgggccccccaccccaaccctgcccgccatcgccacggagtgctgggactgcggcatgtcgacctgccacccaactcatggctttcccctccccctgccaccccagtcttcacctctgctccctgccttccatttccctcctgcctacgcacctgtctgtcttgtctagactgtaagctcctggagggcagggcctatgttttttcacgtttcccctgtactgcgccggtaagaactctgacattattatttaagaagagctaataataagaatagtgctaataacttatattagaagcaaactagaaataaaaatagaacaagtctagtagtgctaatgattgcaatgcctcggggatggagggaaagatggagaagactgaggggcaggaggtgagaaagagagagattgctcgagcaaggtcaggattagctaaggaaagaagaagaggaaaagcaccttcttctgggcctgcgaaacatcagaaagggattgcaggggcctggagggggctgcctgcagggctstccagatacgcgtggacaagccctgtctggaggatggggatgctggctccgggaccgctgcagggtcgccgacccaggaagggtcacaaaggasagtaggtcgaggccgagggagagagacgagggcaggtggagggaggcgcgggagacaagaggttgccaagagcccccggctctgcccaggccgtgcccacgccccgctgcggagcagcccgctcacccgcccgcctgttgttttccacagagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtgtgagcgcgcgcgccgggccgggctgcgccccagccaggaggagggcgcggggctctctgtctgcagctggggacacgtcggggctggggacgacctcgctcgccccaggctgccaggcggctgggggtgaaggcatttccctaaggaaatgcgtagggaggcagagcctcctccccaaaagtgggaaggggcgggcgagggcggaggaaggcgatcctgagccttctccgcacccccgggaccgaaggcttgggggagagggagggaggaggaggctgagtgtcctagagcggctgaggccggaggcctggtgtccccagcctaagcagagggccccgggrgccgggtgggtgggggtctgtctggacgaattgttctgtgtgtgaggtctgagctctgaggcagcagtgttagcacaataaagaaacattgagacgtgagtccgaagtggctgtccgcgttccacggaggttgggcacggggtggcgaaccctgcccagggccggggagggttgcttctgtcgctcgcctcgaccacgccccctctcctccctcctgcttagatccctggcagtcagagctggaaggggccatccaggrcaactcctctgaacaacatacaaagtgcagataaaaggaaaacaaagacaaaaagaattagctcagaatatctacgaccgtaaaataaactgaggaaccgacaaagtgcaatacacttgccatttctaaatattcaaagttttcacatgtcaagattttctattgagaataatgtgctctgaaggtctagggagtctttgtatgttgctgaaagctaaaaggaaaccagtccttggagcacagaaggcacaggcatccggtgagacagaaacaaggacatgtgaaaataagactacaacctcttatattaaaaaactaagtgccacagttctagggtgctgggtgaagtgcaggaaggagggggaataatatttatatagcatatattatggaactcggagagtatggtaaatcccttcacctagatgctgctggtgttttagaacaattatttttgtggttcttttttttttttcatttgtctgcagttggtcaacttgtgcagagcccattctgcaggagatgtttgagaaataccaagtgaatgagtgtggcagcattactttatgctagaaaaaaaaagtttttagatattttacagttactgccttatgatggaatattctgtggtgagaatctaggcctttctgagatccagctccacgttcttacaccctgaagtagtcagccactcctagatagggattaattgagctatttagtatttaccagcacttgttttgttaaacaccttgtcatgatatttacaatgtattttgggggatgttttagtcatttttggttcaaaagtggaaatcaataagcactgtttttgttaataggcgcaagacgtcctctcttgtttagtgagatggggagtgcttaattgaagagtaatgtttgagataaagttccaaggatatatttgctaagcaaacagtaagtaaagtgggcagtgttatagatgttcctttgttgataaagggaccaggtggtcacacagcaaggagggggatgcagacaagtagacaagctctactaatccttctttgttcaacatcatctctgttgggcattggaatctactttgctaatgcaatgcccacttgcctataatttaagaatttctaatatggaatagaaatgattaataggagaagcttggctggattaatttcctgtgctgagaaagattaaacttaaaaaaaaacagttaggtccatcctaaatgcccaagatttaagaaggaacctcatagttcaactgggtatttgawgaatgtgaatgattttgtatttgatgagcygatgaggacagtatagtgatgcagagggtaggtgcttgtacatctgaattgtctgggctgtttcttattttatatgtaatttatttgtatttaaagagttcattttatgttagattatttgtgctttggtagcaaaaatatatttgaaagggtaagttcctgaaatcagcagtttcatgtctgctaggagacaagtatcaggaaaagtagtgtgggttctatcatttccatgctacaacttggatggtgttaccttaccactttggtcccttgtttcagggatgttagaacttagcttagaccttcctcagaatccttttggactttgtgtttcatttgtttggcctgccttgattttatttggtcatccttcttgattctttcatattatttgtttacacttaactctggaatattttgrtggttgttttcaatgtactgtaggtctttaaattggtttataatgaattattgaggagaatagcaagttgttgacattatatctgtctgtagtaacattagaatatttccatttcaatttgttgggcaatttgcttgtggaaatataagatgttatatttagttctatcaaaaccaggatctcaatattattcttttggcaggttgctgcgtgtgtgtgtgtgtgtgtgtgtgtgtgtatgtgtgtctgtctgtctgtctgtctgtctttgatttttttccttcatattttccccttaattcggtgtcggtcaatactgttgctgtttcacatccattgtcacataaaactagtcatctcattctcccaggccccctgtccttgggaagggatgtgcactctgcaggtattagtgattttatatagctgcatgagttgctgggaaaggccttggctggatytataatgagctgtgtttactgagcattatgaagtaaagttcaatatgattactctgaagtctgacctaaaaaaaatsctactccttcactatacagatagggaaactgaggcccctcaggctggactttaaatccccaatcttacttttccattttattctagaaggtcagttgagaggaaacacggctctgtcatggatgacctctaaatgatccctgaccattcttagcatccttctttctcttcccctcattgacctaatcttgacttcttttatctctttcagatgtatgccttctttcttaatagccaggaagtgttttagagtcatactctctggtgtagaaagaccttcaaggccaactaacccagctcccccttttggtgggaaggggattggcatttattgagcacctattaagtgttaggtgctttttgattttttgtcttatttattccttactttagtcctatgaggttgtgtattatccccattatacagatgaataaactgaggctcagagggattaggtatcttgaccaaggcaacaaagataataaagataattcaggatttgatctaggcatgtttgattccaggacagcaggctgtttctctggcatttgaattccttctatagcattcctgacaaagggtatgtaacgtcttcttgacaacctccaatggcagctcactaccttccraggcaggccacttggcctctgactgtcaatattcaacagaacatttctctgaacccggtttttgtccccatatagcttttatcccttgatccaagttctactcttagggaccccagagcattgtatttctaattcagctgcctctagtggacaaagtggttgcactccatacaggatggctgcaacagggacacaactggacacttgtctggtctagttggtaggaggtgttcagaagagcacagtacttcaaggtcacttcgttctactttcctttccccagctgcttgcttgttgagagcccagcctctttcttctctctttgtctcttttctcttgaggagaagctagtcttcctcatttttcctgctcctattctagggccacaggaggtgtggggtgtgcatgggcctcaaagtgtctttaggaagcccctaaacacttcttagtaacacataactaggaaaccctcaagatgacttgggtatttgcaaaggggtgatggcattgccagctctgcttttatagagcgtgctgagagacatgagagatagtaatgaggcaaaaggaaccagagaccactgtcttgggggtgggaaggtggggagttcttgggaatgggaagaggtatagggaaaggacgttaaataaggagaagagcagagaactccaggaaccatccatcccttcatttatttggtcatatttatgagcacctataagacgacttgtcatagatgaagagatcttcagcagggcactgtgcctggcatatttttgccctaaggcaaaatatcccctaaggcaggggatggtataggatgacttggggagggtgctccctgtctgaggagcctccagcttagcttcctgaaaggtgctgagggacagaggcagccagttggctgtgcaggttgttgaatgatataatcttccctattccaggaacaagggagccatgatcagacttggcctctatttggggggtgggaccagtgaggctctggcaagaaaggctcactaaaragcagcaagagagattttatagagactctgagaacagcttcctgttagggtgagtcaacagggaaggtagagatttcctaaatccaatgctgagatcacagtcgtcactgtacttaccaccccaggagaacgagggaaggaagtttctgtttgaacaattttgcttcagggatgccttggtgttttttgttcatttctcctgcatgaaaccttgttcagtgctggaggagagcacttgtggtgacatatgttcaacagtggctttgggagtagggtgtagggtggggtagggactgggaagccctgatttgtagcctttgctgatttccatgatgtcaatgcttccactatggctgaattcaagctaccaacatgatgtgactggcatggaattgggagaaatgtttagtagcacatgattgtatagtatttccatgatacagatacaatggaggaagtaaataactttaagagcttaggtaatagtgaactgtagtaaagtcatcaggaagtggtgagttttgagtacttatcrcctttgttttaatatcatttaattataaatgtatgtaatttactttttaataatggctgcatttaacaactggcttgggaaagttaggtggaccatgtcaccccaggcaagcagaacgctgggcacacaagtgttgcctcaagaatggaaatctcaagtacatcttgatttttctctatttttctagagagatgcaaacagcacaaagttatgctacttctattaaatactacataaattgtcttcatcctacttcctagttccgccttttccrtctctcccccgccttgctggagctgaattctggttcctcaggtcactgaagaattattgagagaatttgtatccccttggttccaggttactcttttgatagccgtcagaaacctgcgttggcatccacagaatttgcctacatttgtctcccagggcatctagccatgggaaatctattcaagagatgcctgtgagtcctcattgtttcagttccttctctgactctctccccaggctctaggaagtcatcctctagtcatcttctcttaagcccctaattcccaagaccatgagtcatatggagtcccacggaattttcttctgtgtgctcctcttttgttttcttttttttgagacggagtctcgctctgtcgcccaggctggagtgcagtggcgcaatctcggctcactgcaagctccgccttctgggttcacgccattctcctgcctcagccttccgagtagctgggactacaggcgcccgccaccacgcccagctaatttttagtatttttagtagagacagggtttcaccatgttagcagggtggtctcgatctcctgaccttgtgatctgcccgccaaagtgctgggattacaggtgtgaggcaccgcacccggcctgtgtgctcctctttgagtaactattaccatgtatgctgctcaattacatttcagctactcaaggcccagtcagactgcrgtgactctggggaggggttaataataataattattattattttgcctctctgggaacaaggaagttttgggaattacccaatcatgatccttccagagttacaaaaactacttcactcctatgggtttaggttggggcctgcctggaggcaggggactgaatctgtagccctgtccactaagctgcccagggagtctcctcatggctcrtttccctgatttggtgggaacctgggaaacccctgctctggagttaacagttaacattctggagttaactcaacgttcattcagcccatctggagtaaccattttatttattcctggtgtatggaaacaaaactgattccattcagttctttgcagttaggttgggaagaatgtgcagyagaggggtgtgtggaggacatgggaacttgcagacaaggtggggatagtggctactttggggaatctggaggagctgggcgtggtcattgtgcctgccggtggggagtggacaggatggccttctgccacccctctgtggccattgccctccccagtcttcttagatgcatttcagcaggatgggcaggatgggacactgagcaccaaggaggagactgaagccttgacaaaggcaggaaattgagcagaggaggatggggtgaaactgctgatcacattgtcgcagaggctgagtttgaggtgatagtggactcctgtgtaggtttcttgaggaattaaagaagggaggaggaagaaaacttgtaatacatgtttgtgagttaaccatgttcccatctgcaaagaaaaaaagcttcagttttggagccagacagatgtgggtttatagttatttaataagcttccaaagcctcaatttctttgtctgtaaaatggaatagtaatagggctgttttgtgtgacaggtatattacagagcctggaacatacggctcagcaaatggttgatcctcaaccctccacacccctagaaagtaattgcatctctcacaagaggacaggcctggaggcacggatctaaccacacagaggtcaacggcagaggctgggggagtgggaggtccacagggagggggacggagtacaaagaatgaagccttgggattgaatttggagatggctcaccatctgggggaagaggcaaggagtccagaaagccaccagtagagaaggaggagaaccaggacttgcctctgagtcctggaatccacatgcaggtgtgaatawtgacaagaatcctcactagtaataataatcctaatgataacaggaagcacctgaaacacaagctcgacagggtcccagagtcagtctggggataagctgccagaatcctcagggtggcccacctgggccagggtgygttctcccgtgccgtttcccatctgcctgacctcagttcctggcactcaggcccctgatggtctccctctgagcccagggctcactgtggtgccctctgtagccctgactttgacaacccctcccaggtggagggtcsctcctgaagggttgccacacagctttcccagagctgaggagggaccttcctggcaggtgtgtgggtgggagggcacatagattttcttcaccgtttttgggagaattcattcagccttggaagtgaactcctttagcccaatccaggccccacttctggcttgcctctggcctgggaagcgtcctcctgtcagtcccttcagatgccccctggtctgcccccttcttctgcccagatgccatctgcagccttgtggctcttccctgcagtcactcacctgaactggctcctgtgcctccccaaacactggggttgtggctccaagtccctgtcccagcaccgtccccacctcacctcagccctttgccaaggctggtccgtgaaactcccctacctctctctccttgtcctctttcttcagaaaggcagactgaccttaccctgtcctcttatcccagtctcttgcctgctcccagacagtgtttgttatcctcaccctgtcttgggagtatcctgttatcctcccatttccatcagactaggtttacccctgagggccggggctgtgtctcttcccttctcaacatctactttcttgagaactcagaatgcctctctgcgctgacctgtcttaaaattaatgtggcggacaaagtttgtattagagactgctccctcagcttagggaggmgtctaatgacaacagctaatgcctgtggttacctccaggacatgaggtggaaaatgccacgtgtgttctcccagatccttctcagaggtgcatgtgaacattgccctccccaagcgcgctcatcacctggtgagcagagtcagccagggcctggggaacagcctcacaggwgctctgggcctcccaggcatagggcgtgggccatgtcaggctcagctctgcaggataggtcacagtttaacagactctgttgaaagctctttcctgtcccgcatgcaggcttctcactcacagtttactaaggacttaaaggtaggccatgtttgtgatcactgccatgaaaacattgagcaacagatcctcggtcaggagmctaacctgctatyacaacgttgttcctgtggggaaatctgcttctgtcttttcaataaacattagccgtcccgagactgtagcacacagtctgagaaagtgaggaatgaggatgggaataatctcctccccagtcccccaccacctctctacctattcacctaagacctgcatgccaataatacccaaaatttatacagccaggccagccctttctcctgcattccacactcacatacctgcttagatgtttaacagatgtctcaaatgtagcatgtcccacatactgcctctacccyacctattgtcttccctgtctcagctgatggggactccgtccttgtttaactcctttttctctctcaccactctcccaccacatccactgggtcacgaggctgagcaatatattgggttgaatcatatgaaaatttcattttttaagtgtaaaaatagtcaaacacaggtaatttcatatgattcaatctaacaatttaaatgtaagatgacttgaggaagaaaagtcatctcttcagctgccctgactccacctcctataaggacaactgggacatgcctgtaacctagtagatgttggcagagctccttcaacatgaacttgggcatggagggactgcaagacaagagggcctcccacagcactctcagcccacactggtcgggggccatggtgtcctggtcagcttctctaccacctggactgaatcctgcctgcccagctccagaaagtcctgaaacattcaggagccaaggttcagaatggcagggagtgatggaactgcctcagcaaccatggagaactgtccttgaccccaacccctctgaatccaacccacctcatgcctagtcctgcagcattcagagccccatatagattgtggargtgaggcccctgatgctgtctgaggagcctttccaagcaacaggggcaatgacttggccaggcaggcakggtcagacacagaagggcagtgcatcagtcattccaaagttgctggcttcatagatacggtgattgtatctattggctttgtcttcagtgcaaatccagaagcaaacccttctttcctgttacytcccagctcacagccaccctcatctcttgcctggattacggcagcagtgtcctgactgatttccctgcttcctctctctcaccttcagttcattctcagcagagaagccagaggaatagttaaatcattcttctgctcaaacccctgaaatggcttcccaagatcaagttccttacactagtgccccaggccatccatgtcacctctctgacctaattgatcactcttcttcctggctctctcccctgagcatsactggctcttcattgtttcttgaacaccttagggtccttgttctggctgttctctttgcccagaatggctctcctctggatttcccaatggcttaattctcacgtccttcaaatctttgctcagttttctccctcttagtgatgtctaccacggccacctcrtttaagattgcagcacccacctgcctgcgctcctcatcgcccttatccccccctcctacactgcttttttccctttaatctgtagcacttatcctcttccaacatgctgtaacatttatttgttacgatgtttgctaattgacttgtcctcgcctttccccacactgcaagctccacaaggaggggcacaaggcaagggtctttgtctgctttattcactaatgtacttaagctcctaaaaagtgccaggcatatggcacacactcaataaatattgtttccaagaaagaaaggggatggaggagacaggcaaactgcagcaggaagagctaacccccatctccaggaggtgagactttagtaaggagctgcctatctcctcctgggtggctaagaggtccctaagaggtgcagaagtttgtctgaacccagccgactgattatactgcctggaagaggaggtgcagatgtggaatctcttggcctgagagttttgccttcctcagtggaggagatatctggagaatgcccattttgtctagctgcaygttccccaccctctgagttaaccacttcgttaaaaagtgtgttttggcgatgtgcttactgagtgtcaccagtaggactgtgtgttaaacctgatccttctaggaacatggagccttccaagtgagatgattaatctcatttagaaaaattaaagaacaatgcacacaactgttgattcaggctcatgcaaagctgggagagttgatgctatgagaccacttgaggaaaaggcttctgagaggaggagtgcctggggctgagcctggaagtgatggctggagaccaagatggataaagaaggatattctcagytggsaggcagagggggaagcctggttaaaggggcagagtacatgagtatgtcaggtgcaagggacagagaagagccgagtctgtctggaatcgagggtgctgagctggcgctgccaatagctgagtcatctccatcttaaggcctctgagggcccaggttggctgagagggaaagaagtcttccagctgctatgctccccagcaggggtgggcatagggacaatcacggtatctatgaagccagcaactttggaatgactgatgcactgcccttctgtgtctgaccmtgcctgcctggccaagtcaytgcccctgttgcttggaaaggctcctcagacagcatcaggggcctcacytccacaatctatatggggctctgaatgctgcaggactaggcatgaggtgggttggattcagaggggttggggtcaaggacagttctccatggttgctgaggcagttccatcactccctgccattctgaaccttggctcctgaatgtttcaggactttctggagctgggcaggcaggattcagtccaggtggtagagaagctgaccaggacaccatggcccccgaccagtgtgggctgagagtgctgtgggaggccctcttgtcttgcagtccctccatgcccaggttcatgttgaaggagctctgccaacatctactaggttacaggcatgtcccagttgtccttataggaggtggagtcagggcagctgaagagatgacttttcttcctcaagtcatcttacatttaaattgttagattgaatcatatgaaattacctgtgtttgactatttttacacttaaaaaatgaaattttcatatgattcaacccaatatattgctcagcctccaagaatttgttccttttaaagcccctcttccctgataattaaggatcaattaacttctgacttcaccctaaaactaactctttcttttttttttttgagatggagtttcactcttgttgcccaggctggagtgcaatggcgtgatcttggctcaacacaacctccgcctcctggtttcaagtgattctcctgcctcaacctcccaagtagctgggattacaggcatgtgccaccatgcctggctaattttgtatttttagtagagatggggtttctccaggttggtcaggctggtcttgaactcctgacctcaggtaatcracctgcctcggcctcccaaagtgctggggttacaggcgtgagccaccacgcccagccaaaactaactctttctgtatttccaggtttggtaaatggtacctccatctgcctggttactcatgtcagagacctcagtgtcatccttgacccctccctcaaccaaggatactaagtcttgtctattctcttctagctcctaaatatgcactgaagccatccacttgtctccctctctctccccaccttcattccaagctatgatggttttttcctaggattcckgcaataacttcattttcctgccttcactctcggcaccttcaatccattctccatgcagctgccagcgtgatcttttaaaaygtgagtctgatcatgtcatttcctgtcttaaagctcttcagtggtctgcttttacatttataattaacttttaaattctccatgtcctatcagaccctgcatgatctgacctctgccgtcctctcctcccagagtccctcctgctcattgccctctggccctggggaccttcccccagatgcttacacaggcagagatctttctggaagggctttcatggatgctcattcccagcatggcagctcctccactctgctttgctgactcctcctctycccactggcctcagcttgactctccttcctcagggaggcccttccctctgtactcccgccagctatattttgatcccttgttattctggctcttggttttcagctattttcttctatagagattagcacagttttaattaaacatttgtgtacacttgtacagtgtctgtttctgcctgacaagtctgcaagattcatgaatgcagagactcgcctgtcatgcccacagctctattcctagtgtgtctggcatggagtgggtactcactaaagacgtgctgagagaatgagtgctgtggacccgcgaatcagttctccaggaaatcagagcccgctgtcctgagtgtgactccagacccacactgctgtgctccttctgagctgcagcgagagctgggggtttgctcttagtcatgggggaggtgtcagtttcagggggtgggagggaattatgatggaaaaagtccagggggaggggtccgcatattgaggcccacccataacatttgtaattgtaagttgagctaacacattattacgtaaaatatgttctattctcctagcttgacaaatataccttcacaatgacctggaaggccaggtttggattcagaaatcttggactctttggggtttcataccagaactcccagcataggaagaactggctcccttgcccaggccttaaatcagatcctttctcttctcacctgcagctccagcccacactgtgaagagccttgtgcccacagctgtgcacatcctgggcttcctccacaccttgtccataaactgcccctcarctaccttcagacccaggatacaggtaggcattttagtccatcttcagaattcccatctgtatttctgaagtrtgatctaaaagggggagaggcagctacgggtgaatgcaccgttgtctccttgcctatggaggagagccagagctgcctttctgtagtayaggccagggcagcagccttcttgccttggtgtaggggtgatattgtctgtgcttgtggcttcctggggtaatcaggtagggaatagaccgacaggcatcctgttaggcttgtcctttctagacgcagcctccagaagaataaatrctccattagcagctggctggagctggctgaggctctggctggtgactctggcctctggtgtagacttccctcaggtgagtgcatggatgagagctctaccttctcctgactgcccaggcctcaggacaacaggtaagccaagaggctcaggccttcccctgcacttcttgtccttctgctgggagtggccaggcctgtggtcagtccttccaccatctgcctctctcatgtcctcatgcggaggcatccctacgtgtggggatctgtgctcagtgctcaggaggcatccagcaccctgggtgtctgtggattgttagggattttctgggactgttaggctgtcaggttgttatcaatgaggggcaggagggatcccagggtatttctgagcakcgaagagagaggtccaggctaccaactggttgtgtcttctttgctggggggtgggagcgggggtagtggctccctggtctgggagcaggactgcagtgagtatgctggagctctgagctcctgcagttaagccaactgaaggtgggcgtatggttgagtggttaactgcaggtgggcatatggttgagtgggtcagccagcagacagagctccgacctcttcattttctctctggttagacagagtttaaatggctttacctgactttggaagactcctgaggagtctaagcaggtccagccagtgggtacagscttgaagaccaacagggtgggctggcagatgagacagtatcagcatctcagtccaggcgtcccagccaggaccaccctaaccaccaccaggaggatggaaccagcccctagcccttgtgagtggctctcccttttctgtaccatctcaagggaaacctgaagacaagctaccagcatgagatgtcctggtgttcagggaacacagttaaacaaaagtgtgatgctgctgtgggaaagcctgccccaggacaccaccataccatgctgtcttcagttcctgccagctgaagttttattcccaggcaatgctttctccttttaccgtttcccgtggggacctgactggctgtctttggggactgaggtcttacaggccaggaggtgcctttgagctcatgctaggggctgtgtgcctgtgaactcactggaatcctttgttgacacattgctttcttaccagtctgtgagctctttgagggcagggcttgtgatgctactatttagtaattcctgtatcccagttggtgctgacacatagtaggtgcatagtaagtgcttactgaatgaatggatgggtgcatttcctgttctacagatacctgttcaaactttgttttgtactttattttgttaacccagttaatgcttctgacaagawgttctacagctcctccccaccccatcaaagaggagggcccttggcctcaaataggccaatcaggctctgttggtggggagttgaatcttcagtgagcaactggggaagagaaaacagaacagaactattttcggaggccccgaggcctgcatcctcaaggctacctggctttgtcttttctgaggctcggtcaacattttccttggttctctgagttactcacatctttctaatacatttcctcttttactttagttaaaaccagagttggtttctgttgcttgcctccaaagaaccctgactgatataagtgttttcctgttatttttaaatcttctaaagtattgctctgagatggtttctgcttaagcagattcattgaaacagtttacttcatatttggatttttccatttgtcagaacattcttccttggtagtgtggtgcagtagaagggactggactgatttagataatctaaaggtaattctgactgtgccactaattatgtaatttcagaggagtaacattctctttggatttcagtttccacatgagaaataaaaaaacttgaactgagtaaccacagatttccttccagctttaagatcctattattcatatgagtcaatatctgccttttagtgatatgctccattggccccagttacatggtctgggcttatgtgataacccttcaaatatttgagaacctatgctcctgcgagtgttttgttctaggcccaacataaccagtttctgtaatcatttctcatatggtaaggtttttagacttttcaccattctggtcattctcttccagacactccagtttttcagtgtcttcctgaaagtgtggcttcgagacctggacctggactagtcatgctgtgggagtctccccactacttacccgtgtgctcagcctgcccctcctggcacataatgttgactaaggcacagcccaaggggaggcagccacyataactttcctagatctagggatagttattttttgtcattttagaggcccttccttcaggctgcatgcagaacagatgcaggtagccatgaagccaaatctggaaggagatgatgcttcctctgaagatcagtaagtaaccaagagtgattaactgaacaggtgctagttcttaatacacatggaagaaagatttgctacaggtgtcattaatgtttgcagcagtttttttttttttttttaattgagacggagtctcactctgttgcccgggctgaagtgcagtggcacaatctcagctcatgcagcagttttttwaaaaatgaggcactgaatgttcatgtctccattgatgagaaaaatgtcctctctaacccttttcttatgctattcccctttcctattctctctgatatcatgtttcatgagccctttgccctakcagctcttgtatttgtcttttgtacaggagaacagatgcaaaaactattgctcaaggaaaataaagtgaaaacgaggaaaagcaaaagaagatctggagagggctctcacctgaccacaagcatcctggagcaatgaggtagagggtgttctgggaggagtctgatatctggactctcgaggggttctttctgtcattgtaactccaacaaaggggcattccgacgamgtcccatatgatgtggccccaggccatctctctgtactcttgtccttcccctctctctcccttgtttggatccagcccctctggcctccactctcttctttgcaaacaccaaccatgctgccattttagggccgttgcattttctggtctctttgtctggaacactctgtcactgcatgctcactcctccacttcactgggcctctgttcaaatgtcaccccattgagggtgtcatctgattgctttatctaagacagaccctgtctccccaacagattgttctctagccctttactctgccttgtctttaacagaaactaacaacatctgacatatgcttacttgtttatttatattatccagaccataaactctcaaaggcaagggtttcgcttgactactgattcccaagtgccaagaaatgtacccagcacatgcagcgccctcaatcaatatttgttgtggtgtgacttacaaagcatcagtctcaatgctcattagcacaaaattggtctcacagaagcactttgtgtttttttggtggagggttaattagtccactagttgacaagtgagtcattaaggatgggaactttattagagcagtgtggatctgttcaacaaggccctggtgcaccacgctacaaaccactgtcgaaatgaggttgctaagagtcaccttgtggagggagagctgcaggtcccatctcatccagagctgctttgatctgaggtggggccctggagatgaacgaaagaaaggtggggagtgctgtgtattttttccccacaaatccaccagggctsattgtcagatcctgggctttcctttccacatcatttttagggactgaggccagttttgcatgattcagtgaccaggcatgtggcctgactgtaggtggcaggtggggatggtgcaagctgacaggttgagtggccatggaccctgttcaggtaatcttgggggaaggtgataggagagaagtgggtgtgggaaagggatgagaatttgataaagccaggttaccaacagggaacctctgagcaggccaggcagggaggatctgggaacaatcgagtggaagagtggtgatgtggatctggaggccagctgtgctgatcctttgtccaaggtgaagtgattgcccaggaactggggagaagagggaaggtccttggacagggctgayatcctaggtggggagattgaagccaccctgggaaaatagtacttcaaacccacccctgtttcttcaatacctctttcctcgctgttatcaagactggattgaggccccagaaaaaatccagttacacctgggtgagagaaactgtgaaccttatcagctaataatccccgaaggtaagtttagctccttaagtgtttttccagtagtgatcaatactccagagcttttctagacagaatcattcaggggcagaatgtattttcctaagatggccacaataaaaagtttgatggagtcagagtgacctctacagtcctgctgttgggctgtggggtctttgtcccctccccttgaactaaggtaagtcttctgcatttgcatttgaaaatgaatgtggcagattctagagtgcctcagtaccctttctctccataatgttccttctgcatagcgttttatggttcttcactctctcagtttcaggcaggaagactcatcctgagctgagctgcttttcttgaagttgtgcaagaacgtcctgttggctggggcaaattcagtatttcttttcctggccactgtgctggagcgtgaggaaagactctccaccctcactcccagatcctgcaggaggcgtgagagcggatggagatggtgaggatgtctattaatatggtgtttcctgcaaaacggtgcccatctcaaccatgggttgtcaaccatcctcggtgtctacaactgcaatttacctttgagggcccatgaactctgattacctgaaagtccttaggccagaaagagaaacccctgtcccccacctctcactttcacctatttctagaccttttcttacagcaatgccttggccctcaggaagcatcagatctcaaactgcagggtctggggctgaagctgatgctggcatgggtgactcagagttcctctattagttcaaatatgtaatatcttttagagcctaggactcaggctggaggcaattccttggtgccagttggttaatactttatgaatagtggtgggggagggaatgccttggactattaatgtccccatggatctggatcctggagaacttccagtgtcctggatggaatgttctgcttggctcatcttgcccagagaagagccaggatatgagaagatgggagagggaagggggaggtgtgaaacgtgctggtgcttcctgtcctcgtggtgtgatggctgcccaggctgctccttcgaggcaggacaggattcccatgggagatatgaggaccatggtgatttccaggcaccagttatgtcccagagcatcgtgtgcctgtgcagtggggttactgatagtccaggcatcagttcatattgtcctttatggcagatcctgcacaagggggttctctgtctctggacccactctgtcagcatggacatcctttttctttttccctggtaaggacatcagaaagaaagttacccctcyagtgtttggagtcttggaatccttggcctgcctgcaggcctctgaatcctcagtgtgttagcccaaggtcaccttaggtaaaggaacatttctcctggtcttccaacaccctggaaagggaggctcttcaagaataggaaattcttcctagtatctaaccttggcctgcaactatgccatacatttaattgtagaaggtatggaaagttaggactgtggtggacccagttaaatcactggacagaagccatgaggcagagccagaaccagcttctggactccctgcatggagctttctactatcccaggttgttgggtcccttctcagtggccaaagatgctattttatgagccttgaggacatgacactaagtgaaaaaagcctggccaaagggccacatagtgtatagttctatttatatgaaatgtccaggaaagacaaaagcatagaggcagaaagcagactagtgctgtgggaggaatgggggatttgggaggtgatggctaaggggttatggggttttgggggaggtaatagaaatgttttaaaattggttgtgaaggtggatgcccaactctgcgaatacactaaaaggcatcgaattgtatactttaaataggtgaattgtatgctatgtgaattatatctcaataaaggtattttttccctgctgttttcctggcttccactttcttatcacaaatcctggggactcttggggcaggggccaggggccaggggccagggcaataccctcccacagcagatggggccttcaggtggagtgcaggctcagctgttccctcttgcccttctctctgctggagagaatgaacaggaatcagcattgcctgtccccatgcttagaggctggacccagaccctgccttctgggacacacccaccatagtgagggctcagtgactcctccttgctgactccctttctccaccttgggacaagccagctccgacagcctggcatggaaatgaccacggagccctggtcagtcgggtagttctttcaggggcagggcatcctgcggcagaggaagggactgagctgtatgtagagcttagaaccaggtctgatcttggagtttccccttccttcctcttctcaagaaggcaaccctatcagccactggccagggagtagcttatcttagggagccattttgtagaaatctcaggcaagaaggggttcggagtcatttagactcccactcaacaatgtttgtcgataccagctatgtttcaggaagagttgtgttctgggaaccactgacatgcccagtgttgacccagcatcctccttttaagggctcagaattcagtggggaagtaaatgtaagtagttctctgattggggtaagcaatggagattgaagaaaggatgttaatcagcctgagtattggggcaatcagggaaggctttctggagcaagcacaccttgaagactgagtatgagatagccacatgaaggggggaggctgggtgggaaatcatggaaagtgtgttccaggcagagggaatacaatgtacaaaggtctgcagatggatgtgagagaacagttcatttggagaaccacataagagacttcaagtagttgagtctggttgtaaaccaagatatgagctagagaaggccaagagatgaggtgggagaggtaggaaggggcagaccatctgaagcctaaataggaggaggtccaagaccccctcctccccaggaactccacttcctccacctacctcctgcacctgcaggactcctacctgagcaggggcaccagtgccaggcagagaagagagtaaccagcatcaggagcagcgagacaggcaccaccaccagcagcacatctttgtaggaggccttccctggtgctgaacatggaggggtggggttagaggtggacttgatgcttcataagccctcaaccactgactgctggcccttagcatacctgcctcatgatgacagctatcccagggcgtgactgtggccaagtcccagctgacagggttggagacaatgcaggaataggccacatctctgtctcctggtcccagggaaatgctcagcacctgtccgtctgtgaagaggctgtgtggttccataccaaagtccatggttgtctcccgtcgccagctataggttatttcgctgatgttgggggcccaacaggacaagaaaacctggcaggtcttggagggctgagcatccctttctacagcaatgaacacttgtaccacgggcctgggcactgcatctgggaaagaaaagtacagctggtatgggtctcagggatgctgggcagggcccacatctctggctctgggatctacccagggttagatgccacctctggctaggcctctcttgttccaaaatcttgtctggctttccactgcccacaggacagaagctgaattccttagcttgatattcaaaacctttcaggaaacgattcatgcccatctctccagctgtacctcctgctgcttctccctgctcatcctaattaatttgcagttttcccaaacatgtcatgctcttgaatatctttcatgctttcacataattcatctgcgcacacagatgcctttcccttcttgtcctcctagaaaacttctacccatccttcaaggcccagcttgaacacattgcttaatgccttgactgtgaagccttcccaggcatggctctgagctctccaagcactctatctctttttgtagtatttctctcacaatatgtcagtcagtcaacaagagatgacaagcatttattaagtcaggcaagaaaacaaacacattcctagccttctggagcttacagtttggtgagaaagacaaatacaaaatgattatgaataattaattaaataattatgagggtgcaaaatgctgtgaaggaggggcccagaggtgggggctctgtcttgttagcttagtaaacttagctctgtagtgctggcaaatagtgggtgctcgatatctggtcactgaacaaactgatatcctggtgtcctagccatggattcccctttctatacaggttgatgagtaaatcctgagtctcagtggaaatgaggccagtgggagagcattctggtgacaacaggagggctcagtctctgacagcattccaaagtcaagcagagaaaaacctcgttaatgccagttcagtctggtgggatttgtgatatgaaagagaaatgatttgctgggcacactaatagtataaacaaagattacaggggggatatttacatcacttaagaggacaagctgcttccaaacacgatcaagcacagtagaaacacccattgacatttctagtaactgatctgctaattcaaatcgttcttatctattgtcaaagcagaactcctaaggacggctgcttggcagcttcgtgcaattagttctaatcacgctatgtatttggaagcaataaaacagcaatttccttaaaatctgtaattcagctgctgagaacaaggcattttagagcttagtggtgtgggtgctgcatgtattatcacattcaatgtcctcatttcacatgtgcggcagctgagactcagatcagaggaggggctccagggctgcctgtatggtggggtaggttattcactacacaaggacattgggctaaggggggtcacagggtaacaggtggcagggggtggggggtgctgaaatccagccagcactctgcttgccaagatgaggctcagggctgcgtgcatccagaaaggcaccttgcaattgcattggcaccctgagtggctcgcccaaggacagccagttagctgtcttggggggattcaagacatctccccaatttgcttacaatctttatctccctcatggctaccctcttcccagctgctacctctgctttccattcttaaatctggactcccctctcttccactctatctaaatttctaaggttttactgaaacagtgatttagggtcacccatgcctcttttctagcccattaggtagataaatgagagctgaaagccactctttcttgaccagaagacaaatgatgaaggtggtggaggtggctgtggtggaggtggaggtggagttgttgggaaacaaggcccacgcagcccccagtccatgcagccaaccgaggtgctgaatgtagctgcgcgaatggctctgcagacccatgcgaagcagaagtcgcacccagctgggcctgccaacccacggaattatgagaagtaaacatcgttgttgttttcagtcagtaagttttgggatggtttgttttgcaatgatgaatgactgagagaacccatgaatcatatatagttaagatctctctaagaagcccttttaagaaatgtgtaaattctatacttttaattacagtttcattataatttgatttttaaataaacccattatgtcatagtttagtatggtacatcattttttttcctttagactaatgacacatagtctacacagactacatagactacatagactagtggcacatcttatagtctatgatgatcctttagaactgaggaagcacaggccaggctctgtcctggatgccactgcaaatgccactgcatttcatcctgtgggtactctacatggtaatattacaatgcccatttacaaaggagaaaggtgaaggccagggaggctaagcattgtgtccaaggccactgagccaagaaaagactgagctagagttcaggcaagcactgtgaaatggcaaagcctggctgctgcagccaggaggaattttcttagacgtgactgccagggagcagctgttccctgagtcggcaacatggtcagagaccagagctttctggaacccagctctccctggctgctatgactcaggatgctcgtctggtgctttgtgggggaagagggccaggcagccagtgtcagacacactcaccgtacaccttgagctggagggtctgggtccagggctggccccttgtgtccaccatcaacacggagaagttgccgctgtctccagactccagcggcccgagctccaggctgaggttgctgtgtagctgggctcggcccaggaagcgggaatggtacagagtctccagggagcctcggaaaaacgtggccaggagctcttctgaaggccagagagatcgccagatagcctcacggacttggaagccagggggacgcgctgccaccagcagcaccgagcccccgactttgctcagcacttgggcaccagtaactgtaatgggaagtagggctgaaagaacagagcccctggtcactctgcctgccccacactcctcatccttcttttgcatgcatctgagctgctatagggtgaattggggcccctccactgacattccctccactcaagttgaggttgcactgtgctaggtaccagggataaaacatatggaagataaccccagtctctgcattcatggaacttacagaggaagccagacattcaagaaatcaataaaaatgaattctgttaaataccatgaagggaaaaatgagatgccctgggagaacacaggtagggtgacaggggatctcacccagccttgatgggctcagaaaacaaattgttaagctgagccttgaagaggaatgggaatcagccaggccaagccgagggcggcctggagcaggatagggaagtgtcaccggcagagggcacagtactgacaaaggcctggagggggagagttggtgcccaggggaactgagagtagttctctgtgtgaggagtaggaaattacactgcagagttggtaggagtcagatcatgcagagacctgaaagcaatactggagtttgggctttatctgtagagcaatggggcgtctcaggtaggttttaagcaggagcgtaacaggattagatgcatggttagaaagatcactccagcagggatgtggagaatgcactggaggtgggcaggacttaggctgttcatgttagtccagtggagaagtgacggcaacttgaattgaggaagggagcaaccgggatgggaagaagtgggaggaattg

SEQ ID NO: 12460 - DNA, 74636 bp, Homo sapiens
aatcctgccaccatcacttgctcttagtcaagttgtgtaaattctctctgagcctaggtttcctcatctgaaaattagagtaaataataatccctcataaaagaaaatcaggattaaatgagaatgtaaattattggacacaataataggctcataacaactacttaataaatggtagttgttaattcatattcagtttaagctcatatcacattctattatgtaccaattattaacattttaatgtgctacttctaacgaagacatttgcattttaaccttggtcctcataatacacttcctcattgattctctaagtgtggtcctggtgccaaaagtatcagcatcagctgggaacctcttagaaatgcaatttttcagactcttccacagacctattgaatcagaaattctggggctagggcccagccttctttgtttcaacaagccctcaaagtgcttctgatggatgctaaagtacaaaaagcatggctttaattcaagaaagctatttcaatgctggaaatttgatgcaagttggaagggaaaggaaaaaaaaaacctatttgaggtgatagcggctctaacaagaggtagatagatgggaggggtttgtgcctgacatcacaccatgagcaggggctgggggtgttccttcatctttaggacccaacatgtttcagtgtcacctgtacatcctgggcaactttgaggaagcttcctctctgtgacatacttagcagctaaacaggtttatgttttccatataaaactccctgagtcattaaaattttggagttccctgaggagcacagcaagttggcctgggggtgaaaaggaaagtccttttgttttgaaccagtggtctgggattaaagagactctgggagggttcatttggtgaagcaggagagagactgctctggttagaaactgctgatcagtttgaacactttgtcagttgtcatagtttcatgtttacttgccgtgaagtgctgcaaaaatagcatttcaaatcaacatacacataaaatctcagacactggtgctttttaagaaaatgtctgcatattgaatgcatcttttactgcttcccttccttacccttttcagtgatttatagagggaagagaaatgaagaatgacaaagtgagccccagataaaaacaaaaacttgaccaagtgagtaacgtaaattgattttgtgtgattttatggcaaagttttttgtctttgtttaaaatgttttcccatttgtcttgcagagttgtctcatttgttagtgattagagatggaaaagatctactagaatgtagaataaaaatgcctctaggataggaaaagctcctttggcctttagaagaacaactctgactctgcttcctgagggcaaggtcaggtgtgtcctcacctgcacagcagttggagatctgctatgtgaggactctggagagaaatgaatccagaaagtcccctggacggctgctagcctgagttggcacactgtgagaaccctggaaacaagaaagttctgcttagcagaaattctgagatttcacatccacacacaccacagacttcaacacatccacttcatgagtgttttacaacagcacttgtctgcagccccctcaggggctggaaatgttcactcccagaaagtcaagccacccacatgcagacagcacttatcccaagacaaacctccagcaggacttcagtataggttggaaagcagtagctgccagggcaacctgagataacaaacgccctcatcgcaagttaggagcaaagctgagctgcttgcagggttcgctgagccaaagcatcaggtggcgtgacatctatgggagcatctgggaaagcagagctgccagcctgttgctagaagggttgcagttatgctttctgcatgagagaagatgtcaaatggagagcctcaaactgtggccgactgacatgcgtgcatcttttgggggaggaccatccatcttattggccatatcccccactcatattgtaattacttttttcatctttggagggggaaggcaatgaaatataacataaatctctcatacctaaaaaagtttgtccttcaaatatcagtaacctaatttaaaacatgtgagtagacttgtataacacacacacgcacatgcacacacacagttatagtgcttgctccccaaacacatggctatggagccaagcatgtctctagttaggaacaaccataaaactctgcccagggggaattggaccatggaattaggctcgaactaagcatggaagaaagaacaaacttccctttctgttctctcaacttcctatcaacgtgcgctgcaagagagaagtgatatgctttctctatgagactgatcagagatacgtaatgggtcactaataagagatcttccccagaacatctgtacatgaacagagacaagccaaaggtatatatctctaaaaatggaattggaagcatcagagagcacacctaataccctacaaataccaaggcacagaaagtgaaatagccatctgcctagctaggcacctaaggctgaattgttttggtcagaatgtcacagaagaaaatgtgatccacagtgggtaaagataaaattaggttatttaacgtgtatatagcacaaactaccagcttgtaagtgctctccatatgctcgttttattctcataacaaccctacaagctaagtaataacattatctcctttatacaggtagggaaaaacgggcccagaaaggtcaagtagcccacccatgttcacacggctaatcagttcaaacacaaagtttcagggagagaagtaagtagcattggttagacctgctaattcatgctatctttcagttaaaattttaattttaattattatgggtacataatagttgtatatatttatggggtacatgtcacattttgatacaggtatacaatgtataatgatcaaatcagggtaattggggcatccattacctcaagcatttatcatatctttatgttaggtacccatgatatcttttgtttttttttgttgttgttgttgtttttgtttttttgagatggcgtcttgctctgtcgcccaggctggagtgcaatggcgtgatcccagctcactgcaaccaccacctcctgggttcaagcgattctcctgcctcagcctcccgagtagctgggactacaggcacccgccaccacgcccagctaattttatactttcaatagagacggggtttcaccatgttggccaggatggtctcgatctcttgaccttgtgatccacccgcctctgcctcccaaagtgctgggattacaggcgtgagccaccgcgcccggcctcccatgatatctttatggaaaatatttctctagattattatgaataagtgatcgcttattagaggagatctgggaataggatagtgagtgagtgatctgccctaactcaagtgcgtgtacattcaaccctcggttattttggccatttacctgctctgaattatacaaagcagcttttcatccctggccagtgttagcagattttaccttctactttgctgtgtcacatttagggaatccaagttcatttttcaatttgtttaggcaagcaaactagaggagacgtagagaaactgcttagggagcttatgcaaatctaggggagcctgggaggataggcaatttggtacactagaaagagcaatggccttggagccagatggatccagatcctagctcattttgagatttttcatgatttatttaacctccctgagactcagttttctcatatgtaaaatggcaatggtcatcttgctgggctgttgcgaggtttgagataatatattcatattcagcacacaggtgcaatgaaactgaggtgtttgaggtcacactgctagtaagaggcagagccagattttgtaggatgtaaacctatgcctacgtgcagttaaagaccatgcttgctccactattccgcagtgccaccaaggactctggccttcaggagcatgagccagaactgcaccccatgtgaccagagtcaaacttccaacccagagggacctgtattattccctggcacctggtcattctcctgaagggtaagagatggaggcacctcacccatctcactcttccctcttggtttggctcttcagagcaaggggcttcacctcagaagggtgaattttccctggcacatatttttcttatggattggggcttcaccctgctaaactaagcagaacctaacttaaaatgaaaagggagagggaaatcatatgtgcacttgtttaaaacattgagcaactgaatcaatttagagtaggtttaaaggaggtcagggctccagcttctattctcatataagccttgaacagaaaaaccactcagccataggttgtgccagaacccattttatggccttttttattgttagatacagggtctcattctgttccccaaactggagtacagttgcatgatcatagctcactgcagcctggaactcccaggctcaagcagtcgtcctacgtcagcctcgcaagtagctacgactcctcagcttgcaggtagcatgcgccatcatgcccagctaacttttttattaattttttttttttttggtggagacagcagtcttgctatgttgcccaggctggtcttaaactcctggcctctatcagtcctcctgcctaggcctcccaaagtgctgggattacaggtgtgagccaccatgcccagcctgttcttaattcttcatttgcctttcctctcctaaaaattgcaggttaccccacagactactctattgctttccatgtagcccaagcctgatctttgttcccactccaccactaagtgcatccttggcaagttacttgacttcattaagcctcagtttccttgttgtaagtgttgctttgaggatcagtgaggtaatctacttagcatggtgcctggcatatggtaagtaagcactcagtaaatattagacattattattagtagtagtatctaaccacttctacttccctgtgtgaccaatttgaatctttacagccactggttctttgcaaatccttctaggaaagcctactttctgccaatgtcacatggttatctcacagttagggctcttagcaactaaactgatctcacttacgtttgattactttgatttaaagtcccaaaggaaccatctcagtaaacagatctctacctaaactttctgagctcagatctcctcctctgtgaatcaactttcaacaataattgtagattctgaagcattaacaggccctccctacatttgttgcataaatttgttaataaatgattattcttttgttggttcatttatgtatatcttatcattaaggcattcaatttttaaactaagttttaactacctgcagcattccaggaattgtgctctttaattagattgtaaattattcaggggaaagagttgatctctcatttctttgagtttcctaaaagtccagcacagttcttggcacactggagggaacctcacagttctacgcaattactgtgtccttgaaaaaatgaatgaaataatcatttggggacagtacattttccattgggtagttgggctggctactgagtgaagtctattatgaatcgccttgcgaagtgaagggttcttctgtaatggggaggatcctccagtcttcgtgtatgtgtgaactcggaatttcatagacggccttggctcacgatcggtttggcacttcgcgttcctaggccacaggacgtcgaacctcgggcgacagcagcctcccgctagggggctcccgacttcccacggaggttccacctgtactgcgcagcctccgtccgggagtgggcggaaattcccttgctgacgcgcgtgacgtcaccggagggcgcggtctgctagagggggtggggcattcccctgcagcaaggggcggggccaccccaacgccgcttctgcggccaaagtaggttgggagtggaaggtggtggctgctgctccgcagtgtsgggaagatggcgccgccggtggcagagagggggctaaagagcgtcgtgtggcagagtgagtgcggtggggtaggggttgagagagggaaggccgggaggctgccgtgccgggcctcgttttgcagccccaaccyagcggtctgttgaggagccgccgcgagcacttgttgctttgggacctgtgtgaggacttcttcctgctttcctgccctgccttattccttgccagcaccagggatgggcggggtgcgacgggacgcggccttctcgttggcgtcgggcaccccctcgcctcggccgcgctctggccgcgaagctccgccccgggtgagccgcccggcccggctttccctcccgcggagcccgtgcgtgccctcggccgcgctccccactcttctccgctcccgtccgcgctccaccagttggggatgtctctccatccgagacaatycgggcgctgtttattccgcccccatctccaccccacactggagtttgcaaggactgtttattctgcttattcgtgttagtatcaacccgtgcttttcaaaaaacctcactgtttaacagactcatcttcccctattccgagaggagcctactttctgaaaagttcttgagaagagaccattggaatgaccggtgtccagccgtgacatcttcctgcatagcctgggcaagagccgctccttccgttttccctactctcgggggcccctccctgctgttaggaccggactccttattggttactgatgttctgcggtatcatccacaactttcataaacatcgctccaaacctaggtctggcaggttagagaaagaatgaaaccacccaacaggaataaccatcattstttggtatctctgagttcaagataattatggcctagtagtggaaagggagtagcatctaattagtatttcttagtccaacttgttgaacaaaaaacaaatgatttagtcagcagaattctgggagttagagttccttgtctaaaattaaaaatccaaatcagtaactgggatagtgcttaacatatagcaggcactaagcaaatgtataaataggtgaaaaatatgaaattatcttttaaaagattagataattttaaggttggcatttgctttttcaagatttacatggctgacttaagatttgagatgttttaaaacaatggtatttaaatacatttatgtgaaaatgggtaacaaattgtgttgtataatttccaagatatatatgtgattaacatccgcatgtatgtatttaagccagttctttacatattgaatcataagcttttccctttttcacattttccttctgatcctcatacagataaagacattgtttttattatctgtcattctgtgacttccttttttttaaacaactgacattgactcaacatttttcatgttgcttcacaatctcgtaattaacwttttaaattgctttttaaataccttgaggtggcaaaaaattttgatagcagaaaagaaaagaaaaaattatggccaggtgcagtggttcaygcctgtaatcccaacacttygggaggccggggcaagatgatcacctgagcctaggagtgggcaacaaagtgagaccccatctctacaaaaaaattttaaaattaaccatgtttggtgacatgcacctgtgttcccasctacatgggaggctgaggcaggaggatcccttcagcccaggaggctgaggctgcagtggacattgattgtgccaccgcactccagcctgggtgacagagcaagaccytgagtctaaataaataaataaatagctagcgtaagcccgggcacagtggctcacgcctgtaattacagcactttgggaggccaaagcaggtggattgcttgagctcaggagttcgagaccagcctgagcaacatggtgaaactctctctctatcaaaaatacaaaaattagccaggtgtggtaacgcacacctgtggtcccagctactcgggaggctgaagtgggaggatcgctggagcctgggaagttgaggctgcagtgagcagtgatcatgccactcaattcagcctgggtgacagagcataactcagtctcaaaaaacaaaaacaaaaattatttgggtaacttttggactagtggaagattaatttagagattaggtagaagccagtcagtggaggatgttaaatagtagagtttagattttattctrtaagcaagagygagcatttgagggaatttcgaggtgtgtattaatataaacaaagggttgtatttcaggaaggtgactctgacagctgtgtgaaaaatggattgaaatagcaaaggtgttggaggtggaaagcaggaaatccagataggattctattgcagtacttcagtgagagagaagaatcaagtcgatgctgggtgacagtagcaatgaaaaataatagctaccagggagaacaatcaatatgcctaataggtgggcgtggggaaaggaggaaatagacaaagacaatgactaagaaaatgacaataatacttagagaaataagtctagagtagttttcagggtgctgtaatctcaacttgagacatgtagctgcttgtatctgtattgcgtagttgaatgaagttcaaagagagaaaggctgtaagattgtggaaaatcgaaagattaatatgatagatgaaactttgatgatgaatatggtctctgagaagaccagccacaggagcaaattctcttacctttgctctgagaacaagcagagcaaaagtaagagaattgagtcttgagatatatccatatttaggatgctagagaaatggatataaggtcaaatgattttcattagtatttagaggaaatacctccttagttctatagtatttgttgatatgatttcctttgactcctctctaaacatacctacctgtgactgtgtcactttttatgggtgcccttactatctccataaaactagttckttcttttagacaataacactgactctgtaggtatcttcagattctttttattttttcstctggcagacacaggtagatccaagtatcttcagattccaagacagttctatcattagaaatttaaagcacatatgtaattttaaattttctagtagtcacataaaaaggtaaaaagaaaaaggtaaaattaatatattatatttgacctaataagttttttacattcctttttttgtgctaaggttttttgaagtctcatatgtattctgtacttacaggatatctcagttcagactagccacatttcaggtgctcaayagccagatatggctggtttccaccatctaggacaatgcagttctaaggtttcaaagactgtaatgagatgacttctgcttggggagcttttctccaatctgctccatcataaattccatgagcattcatttcttaagagaaagacacaaataaatctgataaaaacaagcaaatgtcttcaattttcagctgtttgaggtataaggaatgaagctagctttgaaaggaaaagcagcataatatttctgtatctgagctctaccggagaaaatcctttatttttgcctgtagggttctagaagccagcgcttttggcttaaattatggttaaatatttcggactttcaccataattctcatataacactataatcctcctagcaaacaatatataattatctcaattgatatttcataacacttccaaatcttctcaatcacartacaaccttccagatcacaattctaaaaatgactataaataactgaattgcttttactaacaacatttctgacaccaaatatgtgttttattcccccctcacaccaaccagttctccaactctggacaccagctgtattagtgtcagaattgaaatgaattgtaggatatccagttagttaggaactagttagctaggaacactagttagtgtcagactccacaggtttaagggctcagtctcacaatactgccttcacttcaaatgccagtaccaagtccctaggttacccacacttctgtctgtcttggctacaaagtcaggaattcctacaacctcccttccctttcaggttcattaatttgctggaatggctcacagaacttcagaaaacgcttaacttactattaccagtttattacaaaagatacaaatgaacagccaggttggagaggtacatagggtaaggtcaaaaaaggtcctaagcataggtgcttctatccacatggagttgggtgtctcaccctcctggcacatggtttgttcaccaccttgggagctctccaaactctcttaaggggtttttatggaggcttcattatataagcatgaatgattacatcactggtgattgaactcaatctccagtccctcttctttcccagaggtcctggggtggggctgaaagttccaaccctctaaacatggcttggtctggtgaccagccctcaatctaaagctgtataggggcccctcacccaagagtcatttcatttgcagacggaagagatgctatcactcaggagattccaaggtctttaggggctctgtgctaggaacagggggtaaaaaccaaatattttttattgtaycacagtaactgttattatttataccctctgatagaagagccgtcagtttttaacatgacttgttaccaaaaacttgttgataaatttcccaaaagcattaacttaaatataaattaggaaatagaaaagcttaagttaatgaaataaccatctcattaataagatttaatgaaaaataggttactataayttatattttaattatattttatgtattactatgtattactaccgattttaaaatcaattgaacattaataaaacatagtgtgggaaattgttttattaagtagaacagatatttgtataaattgtccacatgaattatttaatacataatggaaaatgtttttaaatcagtgaactaatttttaaaacatatttagataattttgaaagtcattgtaaggaacatatttattgattataaatcaagactgaatattggtatccaaatgctgtgatatgtattgttgaaaagcataatgtagtaaatcagtatgaaaaatktttatgcagatttgatcatcagatataatttagcaatgggcaacttaaggatgttcccgtgggttttttgttttcatcttgttttacttgggatttaagtagaataggaaaaaccaaatcaggtaataattttagaaatattttctcggtacgttcatgtacttaaatatattaaccctttttataataccttttaaagttaaaaaattgattacagtttaaatgtactgtataggctaggtattagaattggatttttccgtaaggtttaacaaatatgtatgctttttatgtagtttaacaaatttcaaattggatttttccttagccattttggaccctttggattactatgtttctgtttatttaattcctaagtaattcctttcttttttaaacagagataaaagcaacagtgtttgatgactgcaagaaagaaggcgaatggaaggtagagtttgcataccttgctcttataaaaaataatacaaactttaaaaacaatacagtataaaaactacatagtatttacatggtattaggtattctagtataagtaatctaaagataatttgacgtatgtgggaggatgtgtgtaggttacatgcaaacactacactattttatataagagatttgagcatccatggatttttggtatacacaggggtcctcgaacccccatggataccgagggatgactatatagggtctggaatcacactgcttggctccaaatactaacttcaccacttaatagctgtggctccttgcacaagttacttgacctctctctgccccatttccttgtttataaaaatggtgatggtaatacctcatatggtaattgtaaatatgaggtgaattaatccatggaaattacttaaaacagtgctttgtgcaataattgttctacaagtggcaattgtaattttaagaaaatttgatgttaaacagtgtcattcaaaatgaataagctctatgtttcaaattagaaatatttctgtttgtttacttatgtacgatactatatgcatgtatattgagaaaatctctagctcatgcaagataaaagatgagatcattttgcctactgttctgatattttgtgttataaaaggcttataaagtttaatggataaaattctttttttcattcttggtaataggatgcttacagtatttttaaatttgtgtttgttttaagataatgcttttagatgaatttaccactaagcttttggcatcgtgttgcaaaatgacagatcttctagaagaaggtattactggtaagtgttattcttggcatgaacactttttaattgtaattgggggagatctgaggtattaaattttagttagtagttgtgtttctaaggagcttatttttttaaattactgtagccataactattagatttaacattcttttctctgaatcttctgtcagtttttttccctcagccgagacattaatwgacctctaaccargcctaacttaattgctttgttgaggttgttctttaaatgttttactcatatatacwtatatatatataaaacaattttgtatattgatacacaagctttacttcagtattttgatttagtttatggtttcatatatcrctttaaaatggatatcaagatttatgtcataaaatcagctgttgtacatgtttacaaatgcataatgctgacttcgtaaatttatctttattaccagaaatgagacaaataattataagtttaaatcagttttagtatgaaaatttgaaatacttacagattctgaaaaaaaatcataatgtcataagaagttatcttcctctaggcgggattatgttattgagatattaatctgtattacctattgaggaaaataccaatatcttgtaacatgcataatcatgttattcttaattcatcatcctttaactcacttattaaaatttgatcttcataataaccctatgaagacagataaatactctcatttgtaatgaggaatctgaggctccaagtgaaatataattcatttatattttggatcctaatgtagtttatgtaccgtctgttactcctaacttaatgaagttcaaaagtatacccagtattctcaagaaagtctgaccatataatatttatgttttgatgtttacacataaaataatctttttttttttttttttgagacaggatctcactctgtcacccaggctggagtgcagtagtgcgattttggctcactgcagcctcctcctcctgggttcaaacaatcctcccatctcagtctccgaagtagctgggactacaggcacacactagcacrcccagctaatttgtatattttcttggatagaaacagggtttcaccatgttgcccaggatggtctcaaactcctgggttcaagtaatccacttgccttggcctcccaaagtgctgggattacaggtgtaagccaccatgcccagccataaagtaacctttattgtttattacatattcaattgtggtctttctgaccctcaatgtaaaaagctctaaactagaaattagaaaattgaagccttgatttttctactcctggataagtgaaatattgattaagccacttaagttttttaagttctgaaaggtcattctgatgtgaaactagggtgagaaccatttgataatacataaaagttctgtggaactgcagagccattatgcactgtagggaggttttattgcattttgtagaccattgtttcttactgtatgctcactattaatagatattcttcaaggaagggattccatggccagtacatttaggaaacagtattaaacagagctccacagctttctttaggacttaagagtctttatatgccaaggtataagtggatcccctgggtaaaatgatagtattcagttttctaaacttatttggccacagaaagctatttttgagaagcatttcataggactgtatatcatagagctcgctgctgtgggatacctttgatatcctccagaaccacctaagtttgctatggtttaattgtagtcatatcttctaacttaaactcaaaacagtccttttgagttccacattagctctcctgaaaatccctctatgaaactgggcactggcaggttcagcagtcaaactttctgttgtcattcaggtcattcatgaaaatatttagtagtgtcttgggattaaaacaaaatcgggaaaaaaaatgctctgtcaggatttgctacttgagtggagaataaagtcaagtataaaaccttaaaaaaaataaactgaagctgggtacaatgactcatgcctgtaatcccagcacttcgggaggctgaggcaggaagatcacttgaactcaggagttcaagaccagcctgggcaatatagtgagactttgtctctactaaaatccaaaaaaattaaccaagcatggtggcacatacctgtaatcccagctacttggagaactgaggcaggaggattgcttgagccagggaagtcaaggctgcagtaaaccctgattgtgccactacactccagcctgggtgacaaaatgagaccttatttcaaaaaaataaataaaaagtaaaaaacagactgggaattagattttttttttcactattaaagacctttctctttgtttttttagttgtttgatagatgtgtatttttcagtgaatggagaagtggcactttctgttattaataaagagatttcagaatattttcagagcctgagccctaaatcatatytatcacagtattttcagtgttttaacaaatacattattcaccaaacaaaataatatgtatagcatgactgtaagacactccattttgaacattaaacaattgaaataaatgaaaacagattaaaccttaattttttcaagtaaaactataatagttgagaatgaagataaaaagattaaatttttccttggaaatattatttgattgtctagtagtagttatgataaacctatacattactaatatacatttaggaatgagaaaaggaaatcaccatatttaaaagagaagtccagcagtaacctctcttgcccgtcacattaatgttaattctttctaggccctttgtcaacatgaatcttgaaagatggttccctggatttgttgaaggatactttaaattagttttaagaaatatatatgtagctttaaatagttaatttgacaaagtttattaactttatattcactttgctttagctaatcttataaactgcttaatttccataataaaaaatataattgactaaattctagtgatgttctgttgttgaaaaaatactttataaatatgtgtggttttgaaagaataggcgttaattggcaatttatttaaacagcattgtggcaggtaaaaacttgggctctggagtcacatctgggttagaagcctgcctgttccacttcctaactgtgtgattggataagttacttctttaagcttcagtttcctcatttgtaaaatacttgcaaggttattatgaattttaatgagtaattcatgtaagaaaatgaattattaatttaagaaatgaataatttcttacattattcatgtaagaaaatgaagaatttttatttttcatttttcaggattttaaaatgtatccagtgaagacaaagaaaatgttaaacccagtaaatgtttttgttttcatattatttgtaaatgtattttcatattattataaatggaaagtacagtaaagtttatttaaaaattattttaagtatataaatatttggttatataaaatgaccttttttcttgttagttgtagagaatatttataagaaccgtgaacctgtcagacaaatgaaagctctttatttcatcactccgacatcaaaggtgagtattttgagaccttaaaaagcaggttcatcaatatttcaccattgttatggtttactaasagaaaattcaaagtaataaagtacactttagtagaaaaatattgccataaactagtttgcttaggaaagtttttttctgtgttagaagattatttgcattcttccgaatgagaatgtataagtaaaaggattccttttttccccatatatgaaagcagaattaaattgtataaaataacatttctttgcatgttttgtttttcatgcagttcctattgaactataccttttggggggatggtaatgtaggtaaaagaaataatctatagtcttggattacttctttatctcagtgactttcctgtagcatatttgtatgtatatatgaagatgggtatatatgtgtgtatgtatatattttatgtgaaaggaaattctttagtttataatctgactctatgacctaactcatacttgatgccaacctttcagagccaaattatcagatttctttattctgtacaatatctgagaatgcatttttgaaaacctgatctctcacttattcccatgtagaacgttaatttggcaatctctgtttcatttcacttctaaaaaactttagcagacatttttaaaaaaacaaaaagatacacactttttagtctctacatgttggctgctagtgggttttaatgacattttatatcttatctgtaatataattccataagagaaaaattcatgattggaaaaaaaaatgcaacttaaaagyaccatttttcacctagcaaattggcagagggatttaaaatatatatatatgggtatgtatgtgtgtgtgcattctggctattctggttatcagtggataatggagcagaaactgccatatactgctagtgggagtatagattgatacagcctttttggaaaatagtttgtaatttgttatcaagaaccttaaaaaatgttttatattttagagtttattgttaggaaataaataaatggtttagctaagtttctagtagtaaataaatctaawtaaattttagcattaataaataatagaccatatgatgatatctgaatgaaatatatgaataaaatgataaataaatgaaaacccatgtggccattaaaaataatttttctaggggttgttagtgacctagataaatgttcattttgaatgttaagtgacaaaagcaagatacaaaattgtatattcctcattcttgcagtcacctaccaagctttggatctttctaatcacttgatagtttaagcttctcactcactgtstctcacttcaacacttctccagtcataagtcttggtggttcgttatccatgtagatgatacttatagtatgttggtttctagttccttaatctgttatattccartagtcttgtcttctatgttgtttcagttttcctagacctcttcattgccaataagagcatcctgttcatacatattaccttactctttttttttttttccaaaaccaaaaatggttaatattaccttactctttttaccttactaccttattagctatcactggctggagaacatagcatcttaaaaaatcagtttataaattaaacttttagccagtaaagttttattttgtcactgaaataaaataatcttagtcatttcaaaaggtaacatatttaaattaatatttaataaaatgtgtattaacatctaaccttttttaagtctgtagattgtttcttacatgattttgcaagtaaatcggagaacaagtataaagcagcatatatttacttcactgactgtaagtcttttaaaaagttattgcttcattgttcaaaatsccattggttttaaactgtcgactttttaaaaatcagcccaaaatgtcattaaagtatctactttttataatattatttcagtcctggtgattttctatttatcatttgttctaattaggctagaaagaatctaaaaatgtaagattatatctatcctaattcatattaasgtgatagaaaattaaaagaaactattcccaactgctttcaaaagacagtcattttgctgggatgctgggatgtgagggatgggtggagagggctagccctcaaatcctgtgctggtgacaggaagaaatatttttaatcagcatttcagttagggatttgattctcttgtgaaaaacaaagaccttttgagagggcactgaagaaaacagccatctgtttggcaaatataaagggagaaaatctgtcacatttatcttactctgccatatgatcacatagaaaactggtaactaaagaatcacagagaagtccaaagacacatacaattctgtcttatgttayatgttatataatatacttcaaaataaaaatatcatatctaagttaagtcttggtctctgctgttagagattcctcactttaagtaagtagtatatcatttttcctataaatttttatctcatgcctaatagtttgcatttttaaaaatgtcacaccataagtatttgtaatgtaaccttattatacagagcatcatgtttatggaattgatgaaatttaatgaatgtgaaccctcttttaacttaaggaatcttaaggctaaagaatatcatgttaaaagatactaggagccagtggttgatattccaacctagatctartggaatgataaactctttgatgaaaggggaaaaacactggctctgagttccagaacttagtattatagagtcttagaattttctaatgttagaaagctgcctttaattgaaggaaaaattaaccatttgtgttgtatgattgtagtatggatcacttagtggcaatttggaaaagtagtataaatttctaagatgtcctgaaagtgctgctgtttgttaagtcataagtttggacttgatttttcttcctaacaatttcagtttgctctgttagcagatctttaaggaaatacatctgaggttgtggtggatgtgaatgggaaagatggaatttctgttatagtccttttcagtagaatatatcttttgtaaagcaaataacaatatttatatattatttatgtcctcataataactgtgaaagccagtaattatgtataactattcttggatgttggaatgatttatttaaaaggaataaaatctagatgtaactatatgctttgtttttttttcccctcagtttgccctgataatctctttaacaaaattaaggcttcttgctccaagtcaataagaagatgtaaagaaataaatatttccttcattccacatgaatctcaggtactttctatttttattttttagttcatgagaggtttcaaatttggttttatggcttattgttaataaagtatattctgaagatattttttatatgtatttggtgaattttgaacctaatccacaaatagacatttcccatgatgaagtcagacgcgtgagcaataaattggaattaaaaatgaatagcagggcttaaatttcatatctgccaccaagtcctttgtcaaattacagaactaccaggttatgaaatcaagagagttttgagcacagtctttgttagatgactccaaaaaaagtgtttcatttagcttgtgtaaccttttgtgatattaaaacaaatgctctttaataaactttttatataatattatgtaaattattttaatttataaagtgaggggatttttgacttgttttgcctttggaacattgagccttcaattaataatagcaatgattataatgatataagcaaacactcatataatactccctatgtgtcatatactttcctgagtgttttacataaatttattcatttaatcctcacaatagccatagtaatagattgtacttctccattttgaagatcargaaatcaaagaggttaagtaccttgcctcaaatcacacagctaatgaattgttaaggtttgttttgctctgttctctgtgtttggattctagcattttatagaattgaaatagttgactgttgtttggaactatgatcaatattttaagggatagacaagtcctagacaagggatttctactatattacttttaagatactgctgggttttttgtttttgtttttttctttttttgagactgagtttcgcttttgtcacccaggctggagtgcaatggcgcaatcttggctcactgcaacctccatctcccaagttcaagcgattctcctgcctcagcctcccaagtagttgagattacaggcatgcgtcaccacacctggctaatttttttgtatttttagaagagatggggtttctccatgttggtcaggctggtctcgaactgctgacctcaggtgatccagtatcctcggccttcccaagtgctgggattacgggtatgagccaccacgcccagctgatactgctgtttttgacaaagaaagataataatccaaattataagattttaacatatctgcttaacattaaactgttttccaaaagtttcctttaaacttattattttaatatgtaagtttagggtgaaaatgagcttctgaaaatgatgtaggatttaagtggtagtgtgagaaatattacaaacatttctagaacatctcgcttcacagaagataaatataattttagccccagaatttattaaaattctgcagttgctgcatttgaaggaatgatttgtgtagatatctgaataatttgatggtgaatagaaataacctgtctttgcatgtctagagaatgctcttgagaagtttctacttatcagtctttacaaaatattgtgattatgtaaggtcccatctgtgaatggttttcctataagaatttttttcttttaatttacttacttgaaaagagtcttaggagggtatacttgactgggcacagtggcttacccctgtaatcccaacactttgggaggccgaggtgggtggattatgaggtcaggagttcaagaccagcctggccaacatagtaaaaccccgtctctactaaaaatacaaaaaaattagctgggcatggtgattagcacctgtagtcccagctacttgggagcctgaggcaggagaatcatttgaactggggaagcaaaggttgcagtgagccgagatggcaccactgcactccagcctgggcaacagagcgagactccatctccaaaaaaaaaagaggktctacttaataaatctaactgttttggagaaattacattgaaaatattttggatttttgattgtttgcaagtgaaaatgtaaatgaaatactactaggtgctttgagctgtgagcaaaggcctactgagcatttatcaagattatgttcagtggacgttgtttgttaaatgcaaagcagtctactgtgaaaagatgagcaagatatatgtcctaccctcatttgaatactataaagagattaaaaagtattagacattttcaaaaactgtttcaatcatggttaaatcaagtaggactaggctcaactaattaaaagaaaactctggactttcagtggattacacaacacggaaatttatttcttcctaatacacaagaaatcaggaatagkctatataagggtgataatgctggctctatgaaattgtcaggggtctagtctcctaggcatggcccttatgatctaagatgattgtaaattttttttttttactgttatatcttttttttaattttaaggaatgttattttaaaacattataaaaatcataggcttatttcaatattttaaaatatcttctgtaacattccactcagaaggtagataacaaaattcttcccataggaagggtgccaatggaatgtgatattatattattcagttattccattttttcttcctacctcatttttgctgaagaactgctcacttaatatcctgggagtgatcttgttgaaatttgccaccatcatgttgaagcaatgaaccttcacccgtartataatgaatgtgacactgcttatatctatcctgtaggacagctaaaaggacaagacctcagcatcacatgccaaccagtctgttagagcaatcacacacataactacttttgccaaaatcctccaacttaatttttaaatagctgaaatatagtcaaggccatatgggtactgtacctggaactagaaacatacccttttcacacacattcagtgttacagcaacagcatcctgggacaggttaggacacaatcacattttttaaaatcaagagtaagaagtaaacataaaagaatatttgcacaaggcacagaatcctgtttcttggcaatagacagaaaacaactggctaaagaaataggtttacagatagatacaatctagaatttgattctttgagtattaaacttggagacatagctatatacattccaacatacaatctaatattttacattagtagtttcttattcaatatttaaaagaaaaacctaccaaaaaccaacccaaattatatttattaaccattggataaccccttttatcctttatcagccactttactccaggtttgattagtgtaatcatgagattgtctagcctaatgctctagggaaaattctgtgggtgtaagatgatgccttgctgtggaaccattaattattaagctccaagtgaactgaagcagatatttatgaaatgatgatatatttccaaaaatacgaaaaacagataaggcagatggtaactctaataagagtcactgaagkattataatggcactctggaaatggctcatagcaaaacccaacttttttttttgagacagagtttcactcttgttacccaggctggggtgcagtggcgcgatctcagctcactgcaacctccacttccygagttcaagcgattctcctgcctcagcctcccgagtagctgggatyacaggcatgtgctaccatgcccagctaattttgtattttttttttttagtagagatggggtttctccatgttgttcagggtggtcttgaactcccgacctcaagtgatctgcccacctcagcctcccaaagtgctgggatcacaggcatgagccactgcgtctggccctaactttttttgttaacttttaggtttggagtacatttgccagtttgttataggkaaactcatgtcaagggggtttgttacacagattatttcatcacccaggtactaagcctagtacccaatagttattttttctattcctttccctcctcccaccctctaccctcaagtaggcctagtgcctattgttcctctctttgtgaccgtgtattctcatcatttagctcctacttgtaagtgaaaacatgtagtatttggttttctgttcctgcattagtttgctaaggataatgacctctagctccatccatgttcctgctaaagacataatctcattcttttttatggctgcttagtattctatggtacatatatatakagagagagataccacattttttttaatccagtctcccactgatgggcatttaggttgattccatgtctttgctattgtgaatagtgctgcagtgaacatatacgtgcatgtgtccttatgatagacttatattcttttgggtatatacctagtaatgcgattgctggggcaaatggtagttctgttttttaggtctttgaggaatcaccacactgtcttccacaatggttcaactaatatacattcccaccaacggaatgtgagcgttgccttttccctgcggcctcaccagcatatgttattttttgactttttaaaaatagccattctgactggtgtgagatagtatctcattgtggttttgatttgcatttctttaatgatcagtgatttgagccatttttcatatgcttgtgggtcacctgtatgtcttttgaaaagtgttgatatcctttgcccactttttaatggttttttttcttgtaaatttaagttcyttatagatgctgaatattagacctttgtcagatgcatagtttgcaaatactttctcccattgtataggttgtctgtttactctgttgatagttccttttgttgcacagaagctcttcagtttaattagatttcatttgtcggttgttgcttttgttgcaattgcttttggcgtctttgtcttgaaatctttgccagttcctacgtccagaatggtactgcctaggctgtcttccagggtttttatagttttgggttttacctttaagtctttaatccatctcgagttgatttttgtatatggtgtatggaagggrtccagtttcagtcttctgcatgtagctggccagttatcccagcaccatttattgattagggagtcctttccacattgttcttgtcagctttgtcgaatatcagatggttgtaggtatgcggccttatatatgggctctctattctgtttcattgatctgagtgtctgtttttgtaccagtgtcatgttgcaaaaccttcttttctgttaggttcatcacatgggtgcaaccattgtcagtagaaaacaaacaggagcctccatgggtaggcccacgccaagggaattttcctcttatggatccacagaagaaaaataatttttggtgccatgtggcttgtccttatctccagcaaaacaatctagttccctcaaccccattgtgtgtctgggaaaagatagtgaaaatatttccataagaggcaaagactataacaaagctacaagctcactgtgcaaaggtgtgaaaatgtcatggtaaaaagcaccacatgcyaatttttttttttttttttttttytgagacggagtctcattccatcrtccaggctggagtgcagtggtgcaatctcgtttcactgcaacctccaccaggttcaagcatttttcttgcctcagcctccagagtagctgggattacagacaygtacccccacgcggggctaatgtttgtacttttagtagaaatgagatttcaccatgttgaccaggctggtctcaaactcctgacctcccaaagtgctgggattacaggtgtgagccactgctcccggcattttttttttttttttttttttttggagacagattctcactctgtcaccaggctggagtgcagtggtgcgatcttggctcacttcagcctctgtctactgggctcaagcgattttcctgattcagcctcccgagtagctgggattacaggcatgtgccaccaagcccagctgattttttgtatttttagtagagactgggtttcactatgttggccaggttagtctcaaactcctgacctcaaatgatctgtccgccttggcctaccaaagtgctggggttacagttacaagccaccgtgcctagctgattttaatagcttttttttaactggagaaatctatttrttatgtacacaccacagaaaaattgcccccgcccctgaaaaaaaaaaggtcatgcaagaaaatcagattcctaatataaaaatgtatatatctaaagtaggcaaaaatatggtttatgttttaaaaagaaaatatgtaaaatttcactatgaaatgctttgatttgcatgtgacttagtacttatttcatattaaccatatccagttgctatgataagtctctatgttttagaatagctattctttaaaaatatctatttttaagccagaacatatacgttacatttgtgcatccgtgtgtaagctatcctgcttggtatggaatcaagatactaaaagattaataaaagaagttttaaaatcttcagtcacagactagcaaagaatatatttcttcaagttttctgggccacactgctgacttaatattaatgcaatctgaattttcagatgtaaataccagtgagaggttggttgtcaaaacttaaaagcagttgagttgggaggaccttcacaatatcggctcttaaatcataagtaaaattattcttagaactggaccatagtaagcagaaagccttaagttttcttagctcaaaccctccaaattgactcttaacattcataatcatgcccttttagttgctttaagagggcatactgactttgtggtctatactttgtaagagagcaggtaactctagcacaaaagaaactgtaatatggaactggggaggacttcagtggcactattccaattttattgatccatactgttgctttcaaccctgctttgagacccccttgtgtgtcactttctaacatgtcaccaaccatcacacagtccacaggttgtactccaaggagattgcagcattaataaaatatggaaggtgctggcttctcctccctctgctgttcacctacaacaacttggacataggactgacagacacaagcctcatcttctccctctgggtctgtctgaccccattcattactaaaagtaggcagacctcctttctgatttcaatgagcatagctttgacatctcactgaccttagtgtcatgtgctgtaaatgtgtggttttccaaaggaggtaacgttcttcagccagtttcctattggctacaccatgttttgtttcctggattgcttcctcccattgtgaagtccttagatcagtaatgcatgtattgtaatggtgaaaacattccttcttgagtttaacttgagctttatcacaggtgaattcagcctcctgtttatactggtattttgattgtaagagctttattgcctccaacatgcmtctcctgcttgtcacacctgtgtygatgagtgtgttgtccaggtcaaagaaaayggcctgcacgtggctcagccccatagcacctgtgccttgctgcaacctgccacgtcgctgcctgcacatgcgcaaggtgggcggcccaattttgtttttttctttgagagagggtctcgctcaaacagtcctcccgcctcagcctcccaagtagctgggaccacagatgcatgccagcacgcccagctaattttttcttcatttatagcagagatgaggtcttgctatgttgcccaggatgatctagaactcctgagctcaagcaatcctcctacctcagcctcccaaagtgctgggacaggcatgagccaccactcccagccatactgtagaattattacatcatcatttgaggatatacaaaagaatgagagaataattttcgtttttatctcattagctaaaattgagtcacatggctacacataagtgcatgggaaactgagaaaattttttagctgggcatatatggctgttcttcacaaagaactgaagtgcagttactgaaaaggggaggatgtttgttggagaagcatcttgtagtcggccacaaaaggagggagattctctttttaaatatttatttatttgacacattgtaattgtacctatttatgggatacaatttgatgttttgatacatatctgtgttgtataatgatacaaggaatgtatccatcatttcatgcatttaggagccaggttttgttaggttttgtttgtatttttagtagagatggggttgcccaggctggtctcgaactcccgggttcaagcaatctgcctgcctcggcttcccaaagtgctgggattacaggaatgagccactgcaccagcattgagagaggctaattcttactgggagattgggaaaatatttgaagaatggatgtatttttataaggtagtaatgaagagggaaagaacctaggaggtaaaaataatctagatgtaaagatacagaatcagaagagtgcaggagaacagcaggaatgtggcttataagaggtgaaggaatgaaagataggctctctgtaggtaggttggggctattgtacgtaggaggctcctggttctaccaaaaataatgacagaaaattagctggtgcagaaaactgtggaactggtcgtaaagtccttaatgaaaagtagartcctagaagtcaggagatcattgcagagagattggtaaagtcagataygatagtgcttcaaagaaataaagttggacatcagcacatttagaaattacatggagaggaagaagattaactcactcatggtgattccatgagtcaaagggattaaagaaagatctttctttccctttcagaggatttaaggtaagtgatgctgtcacatatataataaggcaagtagagttgatccttgaataacataggggttaggggcaccaaccccctgtgcagttgaaaaatttgtgtataattttaaactcgccaaaaacttaactaccaatagcctgctgttgagtggaagccttcctgataacataaacaatagaataacacatatttttwatattgtttttactatattctaacaaagtaagctagagaaaagaaaatgttattaagaaaaycaaaaggaagagaaaatatacttactattaaatagaagtggattattatgaaggtcktcattcttgtcattktcaagttgagtaggcagaggtggaggaagcggagggattgatcttgctgtctcatggggtggcagaggcagaggaggtggcaggggaggcaggcacactctttgtaacttttattgaaaaaaatctgcatataagtggacctgtgtacttcaagcccttgttgttcaagggtcagacaaacatagaaagcattcaagaatatgagggagtttgtttacagtgaaccttagtgagtacagagagtctggtacagttagtagagaggatactagaagggatctggtagagatagaaacaagctagctatagattagcatgaagartagatggaagacaggatctgtatttaaggagctgattataggtttataaagatgaaaaaagcatgtggcagtagtcttaaaaaacttttaatgatggtgatggaaagtggggaggagatagaggaagagggaaatggaggaaatgtgagtatagaatgagaaccagcacccagattatctttggtacattggggtattagatagcttagattaatttgtggtaggaaccccccagatctcagtgcattactacaacaaaggtttatttctcatttgtgttgtccattgttgtttggctggggctttgctctacatcctctacmttctagtactgaggccgaagggctagtctgggacatagccgagggaaaagagaaaatagtggagccacacaatagcttttaaagcttctgctgggaagtggcacgtgtatcttctacatacattccaggctgagcacggtggctcacatctgtaatcccaggactttaggaggccaaggcggaaggattgcttgagcccaggagtactagaccagcctgggcaacaaagtgagaccttgtctctacaaagaaacttaaaaaaggaattagccaggtgtggtggcacatacctgtggtcctagctacgtgggaggctgaaattgaggatcgcttgagcccaggacctcaaggcttcagtcagccataaccatgccactgcactccagcmtgggtgacagagtgagtccccatcttaaaaaacaaagacaaaaacaaacctacacatgaycatggctaaacctggtatcagtgagtgggagggagaagccttgggcggccgtgcgataaatgtttttaatcgaataatgttatctcctgctgtgggatattatactatgaggaagccacagttcaagtgtagggtgcttgttgacaattaatacagcatcctagccttttgagcaggaaagagataagtggatgagccacagctaaattttcatctatgttcaggctgctgctgttggtgctgggttatgtccagagaaatgaataactgtgtgtaaaaggaaatgcgagaagtttrttcataattcattacttaacctataatgtttattacttgcctactttcacttacaataaattttcatagtttaagagaaattatcattgtttagaaaacaacaaaatttagtttaacggggaactctcaataccatttagggagctcctgcttttgtatcctccaaatcctctaacccagttctttgtacataagtaaattattttgttaattgaatgaatgaatgtatctgtgaggttttgctgtacatacgtayagtaagatttatattatgtctagcacaatgccatgtcttttggggaaatatgtctcttattttaaggacatgaagagtataagctaaagaacggaagacatgtatcaactatgggagatttttgggttactctctaatgggttmaggtttataatttatgtctgagatataggccgattttggtaatgttgtgtttctctgtgctaggagttagatttttattttagtctatctcagattccttcatctgttgcactggtagtaaaaagcagatagtacaatctgtgtatgaaacaagaattgaaggagagaggtagactaaagcaggagaggagagygagaaaagaaataaaggatgaaatcaggatgacagagaaaatgagatttgattaaggtaaagacacagttgtttcaggaaacagcatggttagtgcaagtatttttttaactgccccaaatagttgctgcattttcttgatatatatctatatatatataatatataaatatatatgatatatatctatatatataatatataaatatatatgatatatatctatatatataatatataaatatatatgatatctatctatatatatcatatataaatatatatgatatctatctatatatcatatataaatatatgatatctatctatatatatcatatataaatatatgatatctatctatatatcatatataaatacatatgatatctatctatatatcatatataaatacatatgatatctatctatatatcatatataaatacatatgatatctatctatatatcatatataaatacatatgatatctatctatatatcatatataaatacatatgatatctatctatatatcatatataaatacatatgatatctatatatcatatataaatacatatgatatctatctatatatcatatataaatacatatgatatctatctatatatcatatataaatacatatgatatctatctatatatcatatataaatacatatgatatctatctatatatcatatataaatacatatgatatctatctatatatcatatataaatacatgatatctatctgtatcatatataaatacatgatatctatctgtatcatatataaatacatatgatatctatctgtatcatatataaatacatatgatatctgtatcatatataaatacatatgatatctgtatcatatataaatacatatgatatctgtatcatatataaatacatatgatatctgtatatataaatacatatgatatctatctgtatatataaatacatatgatatctatctgtatmatatataaatacatatatctatctgtataatatataaatacatgatatctatctatatataatatataaatacatatgatatatatctatataatatataaatacatatgatatatatctatataatatatacattatatgtaacataaatataaatatatattttttttaaatcaggtctccagattaacagtgagtttttttgtcttaacttaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaaggtaagacactgagcatctgcacatgttatgcttcctatttaccattcattatagaggtaagtaatgtgtctgtaccttggcatgttggtttgcaaaatttattttctttgtatgattaccatgctctacatataggagatttaaagcttgtggtttaaatttcagactagcaaatagcttctgttactgaatttcggagcctaaatttggtacaatttacgracggtttttcatcagtttaaagaacgcttagaggaaatgtctttatagtcacatagggaatacagtgttacagttaatgtttttcattaaatcaccaacaaatttaaatgaccatattctctggatacctgttacaatgtcaaagtatctatagtatctaatctgcctattctaaataaattttggggttttcttaaggggtaaaatttaactttagtacwatataccttgacttatatacttctttttaaaaatgaagtttactataaagtgcctaaattgtctatacagtaagtcctcacttaaaatgttgttgataggttcttgttaactgacaaaaccaattttaccataggctaattgatataaacaagaattaagttccttggttatgtaatgtcaccaaacttctrcataaagacctgaaacacttcgaatattaaacattgaaagaaatgtgactatatgtacatttaagaaagattaataaaaacaggatcatttttttgcccagttattctagttcaggctcattagaaggatggccagagctcatcccagcagctcatggcacaaggcaggaacccacccagattataggataccatcccattgcagggcacactacacacacatccacactcactcgactgggacaatttagacatgccagttaaccaaacatgctgcacatctttgggatgtgggaggaaaccagagtaccaggagaaaacccatgcagacgtggagggatcatgcaaacgccacacagacagtggcctcagccaggaatcttttttttttcctctgcattatatcgagatgacgaacaaaatgacattatttgaggacgtgctagatatggcatgttaattcattccaaaatgaacatatccatctaaccctaccaaggtcaaaaaaatagaacattaacagcatctcagaggcctctcttgtgatccctcccagctctcccgtcccttttcttccctagagatgactaccatctgacttttaacacatagttaaattttgcttgattttgagctggtataaatggaaccacatgatattttttgtttttgacttctttgcacaacattattttctgagagtcatccatgtttgttgtgtgtgccaggcagttttagttttaattttggtctgctagttcatgtgtgaccctctcgcctcagtttccttatctatgaaataagaatgataataatacctaccatatacagttgtttttagaattaaatgaattaatatctgtaaagcattcagcactaataaatatggtagtaaatatattgcactactcgtaataagtattactcatttgtcttttaaaaagtcctttaatttgaacattggcatttgtcaagttagctggctgaactgtttaattttaaattcatgtagtactttaagtcacattactcttcacttaccatttaaaaattccactattagtacttagaaaaagtatagtgatctccttggagattaagttatctccttaattcaggtattaccagacaagctctttattcataccttgggtattagaaacattctttttctctctttctttccttttttttttttttttttttgagatgggggtctctatgtgttgcccaggctggtctcaaactcctgggctcaagcaatccacctgcctctgcctcccaaagtgctgggattatctttttcttgtcagagatgtgctaattacattctggactcagtggagctaagtggtttggctcctgttaagggtttagtaactgttgaagcttctactgttggtgattggttacgttcrgggaaatgagtaaatatagccaatttataattttatcactcacataagggctagttttgagttatgctaataaataatctgtaatcctgtcttttaaaattctacctgtttccacaaaatattcctttacgctttataaagtataatttaaaaatgaagtttctttcttttgaaaatatagtacaaagagtttaatttattgtacaattaatttattgtacaatttattgtacagagtttaattattgtacaaagagttgaattaccctttatagatgttacattatttatttttaaggtatacaacctaaagattctgtaaaactttgaagccctcacaatgagacctcccatttttgaggttgttatgctggtgaagagcctttttctttctctctctcttttttcttaaataatttttgtggatacatagtaggtgtatatatttatggggtacgtgacayattttgatacagacatacaatgcataatagtcacatcagggtaaacgggatatctatcacctcaagcatttatcctttctttgtgataaaaacaatccaattatactcttagttatttttaaatatactgtagtcaccctgttgtgctatcaaatactagatcttactcattctacctatatttttgtacccattacccatccccactaaacagtcacccaccactcctgcccctttccagcctctggtaaccatctttctactttctgcatgagaattgttttcatttttagctcccggaagcaagtgagaacatgcgaaatgttctttcagtgcctggcttatttcgcttaacatggtgaccgccagttcyatccatgttgttgtaaatgtcaagatccattcttttttatggctgaaacatttgtttcagtatttgtaatagtgtaataagaatgactcatatgtccatctttagaggaatcgatacatagaatccaatataatcatgatggaatactgtataggagataaaatgaataaatccgatatgtgtgtcaatgtcaatgtagataaatctmamacacacacacacacacacacatacatatgaaacagaaatgactggagggagaatacacatgaaattaattataatggttgccttggtttgaggcaggggtatgggagaggaccaggacttaggagtggaataaaaggaactgcaactttacatgtaatattttatttcctttatattaaaaaatctgaagcagatatgataaggtttttccttgtaaattccaaatatatcgatataagattatttgatayattatctgaacttttacatgtttataaaataatttttcattttgtaaacattttttaaatttcagtttaattttagaattaaacttcatgatattataaagtatacactgaaagaaagataattstttgatccttttttccatttctagtaaacctctagataatgccagtaagcttgcacagcttgttgaaaaaaagcttgaagactactacaagattgatgaaaagagcctaataaaggtaatgtatgcaaggcaagtaatgactatgcataaagtctgtcttatttctttataagccaaagaaacttgctcattcattttctagtattgatttgggagtcattaacatagatctccaatactgatttgagaatcattaacatacacaatcgtgcaaaccttaatagatggtatggtttagagggggatctattaactaacagattttgaagtcagcactgtgtccaaatctagttctgccgtttaattcatagttaatgtctatttgggcaaattatgtaacttctatgtaactacattttcttttctataaaatggggataataaaagaatacctattttaaaagttatgattaaatgagttaatacatggaaagtccttagaataatgcttgccaatgtgtaaacatttaataaatgtaggaattcctattatcactagttctgtgaccttgagttttccatctgtgaaatagatgaaataatatataccttgctaggcggtatgaggattaagttagcatgtaagtatttggcaccaatgtgaatttaataaatggcagccattgttatcctatggaaataatataatcaaagactaaggttgaaatctgggaaataccagcatttacatgtgggtgagagaatgaagagcttgaggagactgacagaggtggtgccagaggcctaggaagccatattacagtagctggagaatgaagaaaaggaactgttgctagtttagaagaggagttgtgccaggaaaccaccaattacaatactgtgtaataagtggaatgagagaagaatatacagagtataatgggaatatagtcccgggcttatcttctaaactggagtgttggaaggcatcccaagargaagaggccctttagcttgaagaatgaagtaacatgataaagagggagttcattgcatggaaaacaggattcttcaggtagaggcaatagagaaaaaggcaaaatccacaattaaacagtgtggctggaatggaagatataaacttagatgttaggttagttaccttaaaagtaacctgtttttggtttagaggcctggtgaaggctgttattctggttgtagttttgaagacagaatggcttagtacacatcgtagatagtgaataaatgtttgttgaatgaagagatatacaatcaaatatgcttttagtccttcatgttttcagtggaaaaagagcaaaatccacaaaaattaaacttgtcctttccactctttctgcctggaaaattaatcatccttcaaatacttgatacctttcctttattcagggacacctgataaagtgataaagtgtcacctyatttttgaagccttccttgactcttcaggccaagtgttgcttcctcccacatgctatcataagccctaagcctgctatagaatttatattgcactttttcctgtttatatttctgaagattcatagctcatatttttgagggcttactgtgctgtgtttcatagtatgattatgtttaaccttttcagtcatcttataaggcaaagattccataattgtggttcattttacaaagagaatactgccatgtaaacaggataagcattttgtccaaacttgtactgcaagatgtggtcaaggctggactcagattcagacctagctgatttccaaggctgtgctctgaaccaccatatcatactgtctcaaaatttaattaaattaatgtgcttaattttaaaatattttaaaaatctagcctataaaatttacttgttatatgtaaataaatagaaaatgtttgtataatgatctgtagttatctgttattgctttgaatactaatccaaagaatttattactttttaaaatgaaatakgaaagatactgacattaacaataaatgtttccagcactgttattcactgtttagtgattagtgatgtttgcgaattaatgataacaaggctttcattgtgatttatcatcttagttggtatcagtacagtcttttaaaatagcataatggataagagcacagatgttggagcaaacctgcatttgaatctccattctgcctcttactacctgtgtgatttgggcaagttagttcatttcagaccgcaatgccctcatggtcaactggagataataatgcctgtctcacaggattactaaaagaattaaatgaaatartccatgtatttttgtttagtaaaatgtctaatatttagagctcaaatagtagctactattcataatttatataagttttagtgcttttggaactcaattcatwagaaaatagatayagtgcaaacaaaatgttacttttttaaaaggaattttcaagctattatacagttgtcccttggtaaacacagaggagggttggttccaggacctcctgtgtataccaaaatccacacatactcaagwcctgcatcagcccaacagaacctacatatctggaaagtcagcccttcatacaygcaggtttcacatcctgcaaatactgtattttctatctgttatttagttgaaaaaactctgagtataagtgcatccaygcagttcaaacccaagttattaaatataccctcttactctaattacaaaagtaattagattttagttatatagtcttcatttttcctctcttgggctactcagatttttctttgtttyattataacttcacattcttaagacaattaaccatttgttttgttctgttgtatgtttttggtggggaaaagggacagaacttaggaaaagkgtgctttgtattctaagatattaaaactatgttcacactaagaaattgaagctgcttaagatgattttatcttgttattctagggtaaaactcattcacagctcttaataattgatcgtggctttgatcctgtgtccactgtcctgcatgaactgacctttcaggcaatggcatatgatctactaccaattgagaatgatacatacaagcaagtataacttgaagggcatataaagggcatatacaaacaggatagaatatgagcatttaatgatttatataggcaccagaaatctgaaagcccctataaccttttctattcagagactttatccttctcttattcctacagttatagtctttgacagataatgttgaccttgtaaattaaagtgtaatttgattgctttggagcatttttggtgtgtttgcttccttaactgtgtgtacagtagagctacatttaaacacakggaatttggcccttttgcttttaaaagtaaataccaggctcactatcatatttattgaaggagaaaccatattcaaaattgttaggctataattgttctgaatcatacattcaaaagtgtatgtgtcttatcaacataaagtattttaaaagattggaacactagaaaactaaataggatggctattgaggacaacaggcatagttttaccattttggtaccttctactgagttaatcttggtataaacatatttactttaaaagtaatgtcaaataaaaacctaaatgaaaaatgaaatagttttctatcaaggaatcatcttactgtatctctgtatcatttatggtgtatgtgttacatacattacaaatgttatttgatgtcatgatttctgaatccaaactggtatttgtcagctaagatttactgcttgagtacagtaataaaaatgaaaatagttttctgaaattttatgtttaaactaatttgttagttttaagatacagacacttgtgatagttatgatactgttttttttcttaaatattgttaaaatttgtattttctattgtatttttatttgcattctggtcaaatcttggtttctgagtttttctctgtattatctgtattaatgttagataacatagctatttttytaatataaaagttattttaagcagtttattcagaggrgatattatttacctctgttaccctgtaggtctctaaacttttaagtagacttattttttaaaaagctactatactcccttctttytgaatcaaaaacattcagagataagaattagatggaagtaaagctccctgtggtttgtgctccatcmcaawtttttttttttttttttttttttttagtagaggcagggtttccccatgttggccaggctagtcttgaactcctgacctcaggtgatccccctgcctcggcctcccaaagtgctgggattgcaggkgtgarccaccacgcccagccttcatcacarttttttatggaaacagaatacaaagcagcaggaagctctaagtgtccarattcaagttttcatgttggtgccttctttaaatttacttttttttttttttttctttttttgagacagagtcttactctgtcacccaggctggagtgcagtggcgccgatctctgctcattgcagccttcgtcccctgagttcaaatgattcccagcctcagcctcccaagtaactgggactacaagtgtgcaccactgcgcctggctcatttttgtgtttttagtagaaatggggttttgctgtgttggccaggctggtctcgaactcctggcctcacatgatccacccacctcggcctcccaactaaatttacttttaaaatgggatattcatcacctgagtattgtcaggcttgttactcttatctctgtttacagatcacttataagtcaaaggtattgtgtaagaacaaagtggtattttaaatgacaaaagggctttcatccttagtgcagccttatataattgagcacagtgattctgtctttggtcatctgtaatccacacaggtggatggttttatagattgatgtgtaatttgtgggggttatagaaacgattatattcatatagcaaagtctatatgtattatttgtagttcagagctaggaaaactcaatgcagtccttcctgatcttgactcaggaaatcagtagttccaaggatgattcagtcttgtctagttccacaaatggaaggagggtgtctgcataaaaagataaggggaatcagtcaggaagcccattttgaatagcttcatgaatcccttaaattgttgctcacttcagcagaactcattaaagctatcacaatttttatggcttacattaattttttttaatctcattttctttctcattctgtaaaggagatgtggttatagggttgggggagaataaagaaacagatgataaatgtttgtgaattttgtaccaattctgaaacaccttcaatatttaataggttatattggggaggatattcctgttttgttttgtttgagtcagagtcttgtgctgtcactcaggctggagtgcagtggtgcgatctctgctcactgcaaactctgcctcccaggttcaagtgattctcctgcctcagcctccagagtaactgggattacaggtgtgtgtcaccacaccctgctaagtttttgtatttttttttagagacagggtttcaccttgttagccaggctggttttgaactcctgacctcaagtgatccgcccacctyggcctcygaaagtgctaaaattacaggcgtgagccactgcacctggccgatattcctgttcttaatggaaatttgataattgtactgtgggttattagcacatcaaaacaatgttgtagggaattagaacacaaagcgttagtatattgagtcttgttcttaaagttaactgtaggacgttgaattttttttataaagtacaattttgctgaactaaaactctaataatggcacctaaactgaatatttgaaaatgtcttggtaggcttaggacttatttttaatgtaaggatagcagcgtgccttagttttgagtaggtattcattacccccctaaaatagtggattttacttttcagtttcttgagttgtgtcttgaaattattgtttgtaaaaatgtttcttttgattttggagggaaaaaaatcaaaaagttttagtgcytctgtctacttgtagatataaaacagatggaaaagaaaaggaggccatccttgaagaagaagatgacctctgggttagaattcgacatcracatattgcggttgtgttagagtatgtgaactcattttaatttttgttccataatttttagacactatgtgatagtacattttgtaaccttaaaatagttctgtaaagaattacatcttagaaatttaaagaattctctcacaatttgacagggaaattcccaagcttatgaaagaaatttcatcaacaaagaaagcaacagaaggaaaggtaagagtcttacttaactttcaaagtaatagtgaaggtgaattttaaagtttgtttaaaatctttattttatttctgtaactttttatttttggaaagttctaacayggaggtagagaatgaactcctacgtacccattgcctagtttcaatagttaacaacatttttgtctgtcctgcttcattaaaatttttttattttattttattttttgagacakagtctcactctgccatgcaggctggagtgcagttgcgccatctcagctcactgcagtctccgcctcccaggctcaagtgattgttttgcctcagcgggattactggtgtgcaccaccacacctgactaatttttgtatttttagtagtgacaaggttttgccatgttggccaggctggtctcaaactcctggcctcaagtgatctgcccactttggtgctgggattacaggtgtgagccactgtgcctggccataaagtttattttaaggccatttagtcaattttatcaatgcattgttgggattttacattcagatataatttataagtaaagcacacaaatcttaaatttatactggataacttttacttatatatacccttgaaaccaccactttaaatcaagatacagaacattttcatcattccagaatattccctcttgtcctttccctgtcagtacccctcctgccagaggtaaactctattctaattttcatcaccatagattgtgttcttgaacttcacataatgagattcacctgtgttacgtattttagtaattcatttttttcatttgtgtatagtagtaataccattatgtaaatatacaacaatttgttcatcttgtctccttttgatggacatttagtttgtttccagtttgggattattatgaacaaagctgctatggatttttttgtacatgtaatttggtggacatacacactctttctcttgggtatattaagagtaaaattattgggttatagggtaggattgtgtttagctttaataggtaatgccaaaagttttgcaaagtgtttcaactgatttacatccccatcagcaataattgagtgctctagttgctccatattgccaccaacacttgatatattcttgtctttattttcaattaaaatttcattgcacgagatggtatcttattgtggttttaatttcaatttctctaatgttcttgtgcatattggccattaggatattctgttttgtgaagtgcccattgaaggtcttttgcccatttttaattgagttgtctgtttttcttatttctagaagttattttctggatatgagtcctatacatgtatttatgtatgtatgtatcttttgatgaacagaagatctcaattttaatgaaatctaatttatcaatttatttcttttatactttctctgtgtccttagaagtcttggcttaccctgaggtcattaatatattcttctgttttcttcagtaaggctgatcattttagcttttacatttaagtctgtaattcactatattagtccattctcacactgccatgaataaatagctgagactgggtaatttataaagaaaagaggtttaattgactcacagttccacatggctggggaggcctcaggaaacttaacaatcatggcagaagccaccaygtcacagggagaatgagtgccaagcaaaggggtaagccccttataaaaccatcagattttgtgtgaacgcactatcacaagaatagcatggggcaaaccgcccccatgattcagttayctctacctggtcctgcccttgacatgtggagattattacagttcaaggtgagatttgggtagggaaacagagccaaaccgtatcattctgcccytggtacctcccatatctcatgtcctcacatttcaaaacacaatcatgcccttccaacagtcccctacagtcttaactcattccagcattaacccaaaagtccaagtccagagtttcatctgagataaggcaagtcccttctgcctatgagcctataaaatcaaaaacaagttagttacttcctagatacaatggaggtacaggcattgggtaaatacacctgttccaaatgggagaaattggccataacagaggggcttacaggccccatgcaggtccaaaatccaatagggcagtcattaaatcttaaagttccaaaaggatctcctttgactccrtgtctcacatctgggtcatgttgatgcaaaaggtgggttcccatggccctaggcagctctgcccctgtggctttgcaggatatagcccctctcccagctgctttcatgggctggtgttgagtgtatgcagcttttccaggcacatgttgcaagctgttggtggatctactattctgggatctggaggatggtgacccgcttctcacagttcactaggcagtgccccagtggcaactatgtgtggaggttccaaccccacatttcccttctgcactaccctagcagaggttctccatgagggctccatccctgcagcaaactccggcctggacatccagacatttctatacatcctctgaaatctaagcagaggttcccaaacctcagttcttgacttctatgcaccctgtaagcccaacaccacgtgtaagccaccagcttgcaccatctgaagcaatgacctgagttctactttggccccttttagccacagctgggatgcagggtaccaaatcccaagaccacacaaagcggcaaggctctgagcctgacccacgaaaccattttttcctccttggcctctggacctgtgatgggaggggctaccacgaaggtctctgacatgccctggagacattttccccgttgttttggtgattaacatttggctccttgtttcttatgcagatttcagcagccagcttgaatttctcccccgaaaatgggtttttctatcatatcgtcaggctgcagatttttcaaacttttatgctctgtcacctcttgaataaatgactgctgagaagtttcttctgccagataaccctaaatcatctctcttgagatcaaagttccccagatctctagggcaaggacaaaatgccactaatctctgctaaagcatagcaagagtcacctttgctctagttcccaagaagtttatcatctccagctgataccacctcagcctggatttgattatccatatcactgtcagcattttggccaaaatcactcaagtttctaggaagttccaaactttcccacattttcctgtcttcttctgagccctccaaactgttcaacctctgcctgttacccagttccaaagtttcttccacattttcaggtgtcttcacagtagcaccccactcctggtaccaaaactgtattagtccattctcacgcttttatgaagaaatacctgagactgggtaatttataaagagattcagttgactcacagttccatatggctgcagaggcctcaggaaacttatagtcatggtgraaggcacctcttcacagggtggcaggggagagaaagaatgccgagtgaaggaggaagccccttataagaccatcggatctcatgagaactcactcactatcacaagaacagcatgggggaaactgcccccattattcagttatctccacttggtcctgcccttgacgcgtggggattattacaattcaaggtgagatttgggtggagacacagagccaaaccatgccattcactcaaattaattttgatttatggtgtgaggtaagggtctagcttcattttatttcgatatacatatctgattactcaagcactgtttattgtaaagaccatcctttcaccattgagttgcagtaatgcatttgttgtgaatcaagtgaccataaatgtgtgggtctgtggactccatgtccttttccatggtcaatttgtctatccttgtaacaagaccacactgtcttaactagtgtacctttgtaatggttttgaaatttggtagtataagtcttccagctttgttcttcaagattgtctcagctgttacaacctttgtcttttaatacacattttagattctgcttgacaatttcaacagaaacatttaactgaaattttgattgggattacatgaatctgtacactaatttgggaagaactgacaaaaatattgcatcttctgatccaagaacatagaatatagctccacttatgtagatagtttatctcagccgcattttataattttcattttagtggtattgcacattttttctttatttctaggtatttgattttttggtgttataaatggtatttttwaaattccattttactttattagtatataaaatktgattgatttttgtatatttaccttggatctggtgaccttgctaaatttattttttaattctagtactttgtttatagattggcttttttgtttttaagagatcggaactctgttggccaggctagtctctgaattcaagcaatccccccacccttgcctccctagtagctgggactacaggcaggtaccagtgcacctagctggatttttatatacacagtaatataatctgtgaataaagaaaatttagtgtcttcctttctaaattaatcttccagaggtgtccaaaggagagaatacagtcatgggttcttagtttctgtttcrgctagtaaagtcccttccttatccctcttttccacttatcactagagacagaaactaaaaaccatggcttcaggctgcaaaaagcctaaaacaaaacagaacaacaacaacaacaaaataaggtgggttagacaagcttgtcatacgtttaaaattttttttttttagtagttaatacctcctggttctggctgatacctccagtataacatgaaatcaaactggtgataatgagcgtccttgtctcattcccagctttatgggaaatgagttcaatatttcatcattaagtattatgttagttttaggtagttttcttttatcagattaaggatgttccyttctattcttagtttaccaacaggtttttatgtgtttctgttttttgtttttttcttttttcttttttttaagagacaggktcttgttctgtcacccaggctggagtgcagtggtgcagtctcaactcactgcagcctcaacctcttgggctcaaacgatcctcccacctcaggcccccaagcagctggaattacaggtgtgcaccaccatgcccagctaatttttgtgtgtttttaatagagacagaatttcaccatattgctcaggctggtctcgaactcctgagctcagacaatcctcctgcctcagcctctcgaaatgctgagattacaggcgtgagccaccacacccagcctgtttctgttttcttttaatcaggaaatttcgatgttggatttcatcaaaggcattttgatattgtctttttttcccctttattctgttaatgtgatgaattacatttattgacttactaacataaaagtaaccatttctagaataaactccacttgatcatgatgcatcatccttttcctctatcactggattttgtttgctaatattttgttgtaggatatttgcttctatatttatgagaaatacttttctgtaatagtccttttttgtaatgttcttgtcaggttttagcagcaagatttttttggtcttatgaaatgaattgtgatgcacactttgtcattccattctctgaaagagtttgtgtaagattgttactgcttgttctattgctgcttgaaagaattcaccattgaagcagttcaggcatagagacttctttatggggaggtctttcgttataattaatgataagttatttaatagatatagaactatttagttttttactttttcttcattagttttgggatatcgcatttttcagggaatttgtctattatatctaaattttgaaatgtcctcttatcctttcaatatgtgtagaatctatagttagattttatttactaatcttgctattgttaatttgtttattcccctatatattattaatatcccctgcagtccgggcacggtggctcacgtctgtaatcccagcacttggggaggccaaggcagacggatcacctgaggtcaggagtttgagaccagtctggccaacatggtgaaaccctgtctctactaaaaaaaatacaaaaattagccgagcttgatggtgcctacctgtatcccagctactcgggaagctgaggcaggagaattgcttgaacctgggagacggaggttgcagtgagccaagatagtgccactgcacttcagcctggagaaaagagtgagactccatgtaaaaaaaaataaaataaaattcactgcatatgttwttaatatttcaaagaaccaacatttgtctttgttgattttcactcttgcatgttttatctttaattagctgatttttactcagttttatttccttccttcagcttactttgttttaaatgaagcttgtccaacctgtggcccatgggtcacatacagcccaggacggctgtgaatgtggcccaacacaaatttgtaaactttcttaaaacattatgagatgtttttgtgattttttttttaacctcatcagctattgttagtgtattttatatgtggcccaagacagttcttcttccagtgtggcccagggaagccaaaatatcggacacccctggtttaaattttttcttctagcttcctgagttggagttttagaacattgatttccaacctttcttctgttctattgtatatattttatagttatttacatctcaaacttagctgcatcccaggagttttggaataacttattttcatttagttcaaaacattttctaacccttattatgatttcttctttgacccatgtgttatatagggaatacgtttttaaatttcaaagcatttgggaattttctagttatctttctgttactgagttgtaatttaattatacagtggtcagagaatgtgcactatatgacatcagtcttttaaaatatgttaagacttgatttatggggctgggcatggtggctcgtgcctgtaatcccagcactttgagtggccaaggcaggcgaatcacatgtggctaggagttcaagaccagcctggccaacatggcgaaaccccatctctactaaaaatacaaaaattagccatgtgtgatggcacacacctgtggctccagctactcaggaggctgggcaacagagtgagactctgtctcaaaaaaaaaaaaaaaaaaaattgatttctgacctagcatatattatcataagtgccctatgtgtacttgaaaggaatataaattctgtatgtgtcagttaaatcaagatggttaatcatgttcaaatcttctatttcttttctgatttttttttacctgctmtgtcagttactagaagtggtatattaaaaactctgatcatgactgtgaattagtttgtttttctttagtcctttcaacttttgaagttatattaactgataaagctatgttaagttcattatacatttaagatagctatctttctgttgaatttggccttttatcatcataaaatgtcccttttattacttgcagtatttcttgtcttgaggtctactttgatgttaataccactatatcttctttcttttgttagtgtttacatagtatatcttttcccatcctttactttcaactacctgtgtcttgatatttaaaatgtgcttcttaaaaagagcttgtrgttgaattttgtttttttatccagcccaaaaatcttttaattagaatgcttgtttagttcatatatatttcatgtaattattgatatagttaaatttatatctagtatcttgttttcacttcattttttatattctattcttttccttctttatcaagtcttttttaaaaataaattccatttcatctccaatataaacatttgtgttttgcctttagtccttcctttagttattatactggaaatttaaaaatgtattcttaccctagtttaatagtatgtcctgaatatgtcatgtcctgaataattcaggaatcttataatagtttaactttatcccctttctcttttgtgcagttgtttcatgtattttacttcaatgtatgttataaactcaagatgttatttttttcagaaagaaaaacccaaaaaaataaaagcaagatgttattttgttayaaacactcagtagacttttattattacccacatatttatacawtctggtactgtttatttcttactgctcttcagtttttccagctgggttagattgaattctcccagctttctttttgtctgagggcatcttcgttttgcaattttttctaagatacttttgctggatttggaattcaaagttggcaatttttttcctttcagcaatttaaagctttcaatacatcaccttctggctaccataatttctgctgaaaaaaggcagctgttaagtattattgttttcctgaagataaactgtgtttattaatattttctctgtatctttgattttttagcaatttgaccatgatatgccttactgtaatgtggtttgcttgctatttatcctccatggggtttgctgagcttcttgagtcactgggttgataactttcattatgtttgtaaaattcttggtcattatctcctcacatcttccttttgtcccatcctctctcttctctctttctgggaccccagtcaacatgttttttagatctcttgactgtattctatatctcttgcattctgttacctttttttttttaacctctccgcattgcaactgaatgttctctattaacctgactttgagtcccctacttctgtcttctgttgtattcagtctgctattaaacccattcattgtatccttttgaaaactgaggtataaagcaaaatttcccctttgtagtatacagttctgtgagttttgacaaatgcacactctcatataaccactaccacaatcaagatagagaataatgtcatcaccccccaaaatgtcctcatgcccgtttgcagataaccccttaactcagtccccatcccctgacaactactaatctgttttctgaccctgtagttttgccttttccagaatgtccaatgaatggagtaatacactatggctcttttcatttagcataatgcatttgagattcattcatgctgcatgcaagagtagtttcattactttttattgcygagtagtattccatcatatggatgtaccacaagttgtttatcaatttaccagtttcagaacattttagtttttccagttgttggcaattatgaataaagctactaaaaatattcaccttcttcatatcagacattcatgtctatgaacagatgttatcatttgctaacttaaagtcttatatttaactctaggacattcattggatttttagaaaataaattctagttctctgttaaaatactccatcttttgatccatgtagtccatcttttcctctgtttccactttaacataaatgtgttactttgaagtctttttctgccaacaacatcttaggtctactttttgggagtttctttgtttttacattttgaggtgttcttttcttagcttttttattgatgcatagtaactgtacatatttatgaggcatgtaatatgtttatacgtgcatacagtgtgtaatgatcaaatcattgtatttagaatacccatcaccttgaacatttattatttctttgtgttggggacatttccaatcttttcctctagctattttgaaatacaaaatatatgttaactatagccatcattgtgatatcaaacactagaacttattccttatcttgggtctacttttattgactgttttgtcacttgagtatcaatcactttcctgtttcacctattaatgttttattgtgctagacatggtggatgatacattgcagaggttctagatgatgctgtctctayacagaatgttgagttttgttctggcaggcagttaagttgctgaggaataatcgtgattctgttgtaacttcatgttagacaatgttatggtaaatttatttcacttttgcactgagtcctaaggcatagtcccaggactgaatgtgtaggatgttcacttaggtctctttactttgtctagatcaggagatgctagtatattcttagcactaagacccctctgaaatcttgtccaacatttagccacccagaagttgttctttactacacctttgagggttatgccctgtacatgtgcagcttaggggttcaaggacaatctctttacacatttttgggttatgttctgtctagctcctttctttttagcactctgcttcccaaaatctacctcacagccccaagctcttatctccattttttttttttttttttttttttttgcacccagggagataattgctctctacttgaactgtatttcctttcagtggtgtttggaaaacatctttagggaaaggaagggtgcgtgcagggatcacctttggtgctttccttcactcagctgtctcagctgtgagctatttttatccattacttgaaagctattgttttatttatttgtccaatcttatttatttatgaagggagagtaatgttgatatcagctacgttattgtgrgtgaaactggaagcctcctaaattcttctttcaaaaaaattgtcaaatattcagtaaattaactagatttgataatttgtaaaactctaggatttcaaagttgtaatatggaataactgaatcataggcttgcctaaaaaaatgtttgatttttcctagacatcacttagtgctcttacccagctgatgaaaaagatgccccatttccgaaaacagattactaaggtaagcagtattgtatatgagatacctgattagttttagtttatattcagtttatattcagttctgtagttcgatttagcagtgggtttcgtggaatacttggtgttatttgtcctctaaaaccttactataggtctgagaratatcccatatatctaagcttcttcataacttctctatatgtataacctagatttatctgaatccagcttaaagtttctatatctttgtcttgaatagcctaacagagtcayatttatcaaccttacaagaaattcagcactagattgactagtggatgttattctacatgtttctttaaagtaatagttacttactagtagatttaagagcatttaagctgtttagtcaggtaaactatttttttgctccttaaaaacactatcagaataatcttaacatttttgtcatgttgcaccctagtcaaccaatgatttttgtgtgtgttaaaatacttgaaacatttagaaagataaakagaatatgaacttgaagaacttctgsgtatttttctcatgttatttttcattactgtcaaactcaacacaaattcaacaattcaatgcttccatcccatttatgctgtctgttgattgcctcctgttgtattagtctgttctcacattgctgtaaggaaatacccaggactgggtaatttataaaggaaagcggtctaattgactcacagatctacawggctgggaaggccttaggaaacttacagtcatggcagaaagcaaaggggaagccaggcaccttcttcacaaagcyacaggagggagaagtacaagcagggcacatgccagacacttgtaaaaccatcagatctcatgagaactcacttactattatgagaacagcatggggaaaatcactcccatcatcccatgttccaaacacttcccatcaggtccctcccacaacacatggggattatgggaactacaagatgagatttaggtggggacatagccaaaccatttcacctgtaaatcaccttctcatttacttcctttcttgagctgttcccttgcttacatgttaccttctttcacctcagcccatactttctttcaggcctgtctcaaaagtttaatattaccagttgcacaaaagtcattaaaatcctttaaatgattgatttcttctgtttttcagcaagttgtccatcttaacttagcagaagattgcatgaataagttcaagcttaatatagaaaagctctgcaaaactgaacaggtatgtgcagagtcagaaatgcctctgttcataacaaatttcmaggataaactttgtaagttaaaacctaactttttgcttgatacagtggttggtttttacagaatcacagactctctcttatcaggggagccacctaggcagtatttaatgtcattccccgctaacattaacaagtagctgtagagtatcttagtaaacagtccctcctaatatattatatattttttgtttaatggaatgatttaaattttgggagcatgatttcagggtggcattattggcaggaccttctcagtacgggatttaatatagcatccagcagagctcattttacaaggggccttttatatcatgcctcaactgtttagaccattgcccctcatagaatacaagctgcatgtaattttaattattctaatagccatgttaatgcaggtaaaaattaaaaagtgcaattaattttacgaataagttgggtgcagtggtgtgtgcttatagtcccagctattcaggaggctgaggtgggaggattgcttgatcccaggagtttgagggcagcctgggcaagaccctgtctctttaaaaaaaaaaaagaaaaaaaaaactttgacaacctgatgtattcaaaatattatttcaacatataatcagtataaaaagttattaattagataattttgcattgtattacttcaagtctcctggtgttttgtacctacagcacatcttaattcagactgatcccatttcaagtgttcagtagtcatatgtggctagtggccacagtactggatagcataggtttagattaatgatttttatcttctctgatttattttttgaccttttgtattttgtataaacaatagtttacaagtgatgttcatattttcttgtgtaatgtcatcagtgttccattaaaatttgacaagatttaataatagattttgtgtgtttgttttttgtttttttgagacggagtttcgctcttgttgcccaggctagagtgcaatggcccaatcatggctcactgcaacctctgcccaccgggttcaagtgagtctcctgcctcagcctcccgagtagctgggattataggcacctgccaccacgcccggctaattttttgtatttttagtacagatggggttttaccatgttggccaggctagtctccaactcctgacctcaggtgatctgccttggcctcccaaagtgctgggattacaggcgtgagccactgtacccagccaataatagatgtttttaactaaaaaatgaattttggttatagatcactgacaatattttattttcattaaggacctggcacttggaactgatgcagaaggacagaaggtgaaagattccatgcgagtactccttccagttctactcaacaaaaatcatgataattgtgataaaataagagcaattctactttatatcttcagtattaatggtaatggagataatcactttttaataagtattttactattgatcataaaagaatctttgaaaactgaaagatagttgctgaacttggttaagataaaagggaaaatatgaaatcgagagaagactgaaggagatataatttgactgttttttattttaaaagcttcattcatgggtactacctaaagccttgaaattattttggtagcaattgtgtgattgtgcactcatatttttacctatttaaggaactacggaagaaaatttggacaggttgatccagaatgtaaagatagraaatgagagtgacatgattcgtaactggagttaccttggtgttcccattgttccccaagtaagaagtcttatgttgtgtatatactttatatgtatgtgtatgtatggttgtatgtattaactgttttttttttttatgtggacagtcttcttaagttcactctatagattttgaataagtaagcaattaaagattttgttctcttttccatatgtaatttgggcaaatgcagttttctagcgaatttgtattttatggcttctgtcataattcactacttacatttttgtctttatgattcatttataacaattgtcatattttagttaaacgtgtaacctttaactataatatggcagagaaaataagtatatattttcttgattaaaaaaatttaggctcgctgggtatggtggctcacacctgtaatcccaacactctgggagacgctgaggcaggaggatttcttgagcccaggagttcgagaccagcctgggcatcatagtaagacctcgcctctacaaaaaacaaaaaaataaccaggtgtgttggtgtgtacctgtagtcccagctactcaggaggctgaggatctcataagctcaggaggtcaaggctgcagtgggccaaaatcacaccactgtactccagcacaaagtgagactctgtctcaaaaaaaaaaamaaaaaaaaaaggctcaaagtcaaattttgaagagctctatttagaatctcactctttcccatcttttttttttttttttgagacagaggctctctctgtagcacaggctggagtgcagtggcatgacctcggctcacrgcaacctctgcctcccaggttcaagcaactttcctgcctcagcctcccatctgggattacaggcgcctgccatccgcccagctaatttttgtatttttagtagagacagggtttcactctgtcggccaggctgctctcaaactcctgacctcaggtgatctgcccgcctcagcctcccaaagttctgggattacaggtgtgagccactgcatctggccccatcaagtttttttgtgtgtatgtgtgtgtgtgtgttttttttttgagacgtagtctcactctgtcacccaggctggagtgcagtggctcgatctcggctcactgcaagctctgcctcctgggtttatgccattctcctgcctcagcctccctagtagctgggactacagccatcaagttttataatacttttattttaatagacatatgttctgatatgattataaataaattttagcattaaagcacaaaatactgttcagtggagttatgygaccacactcagattttttaaaataggcatctccactcttagttttaagtcaaatacaatatagtatttactggtaaattaaatatcttcgttaggaaacgtaagagtattatatttgaatagaattactggtttttaatttttttcctctaattgtattagtctcaacaaggcaaaccgttaagaaaggatcggtctgcagaagaaacttttcagctctctcggtggacaccttttatcaaagatattatggaggtaaaaatcattaaaatgtttttttctacctgagtgccctctttagagtattctttactttttgtagtttatgtcagtctgagtatatgtattgggcaggaagtttctgcagtggttggaggcttcacaaaaaagcctgtatctgggaaactcttgaagattcttcttctttttttttttttttttttttctttttgagacagagtgtcactctatcacccaggctggagtgcagtggcacagtcttggctcactgcaaccttcgcctcccaggttccagcaattctcttgcctcagcctcccgagtagctgggactacaggcacacgccaccatgcctggctaatttttgtatttttagtggagacagggtttcactatgttggccaggctggtctcgaactcctgacctcatgatccacccaccttggcctcccaaagtgctgggattacaggtgtgagccactgcgcccggctgaagattcttttcttaaagacctcagacaaactcacaccactgactgtttcaaaaaaaataaaataaacacatatatgctttataaaaaatactgctttgttttaataactgtatgtggcaaaatataatttatttgaatgaaagttcaacaaaataacatttgtatgtggaccactattaaaaagtattagatgccaatattcttggaaatgtttttggattaaaatgtaaacttcattatagtttgctgtcagatgaatcatgcctttaatactgtttacacttagagaacattattcaattataggaaattataaaatgagctaattttaaaattatgagcttaataaaatcatgacactgattcttcggtcatgatcatatagtttttattccccttttcctttgacttaaaccccagtttatactttctttkgggagctaatttggtacagtgcataactatgatttctctgttttgcttggctwattttatgttattcacacatgcttaaacatatatgaaaaatctaaagaatttagactttgttttctctaacataagaattttttttcctttctcacagggatgatatagaactaagtagtttcttatggctagttttttgtttttttgtttttaaacatattcctaatcagtttaccatggctagtatttgtaaaataagaaatgactttcttgaaccccttaacaaagatttgcatgttaaattcagaaaatacacatttggatccatgacagtcttaggcctttagaatttctcctgaaacttgatttcctcccttcttgcagtcttactgaaatattcttggactactgagtactttgtgcccaatccatgtgcccacttgttaatactacttgtactaccatgccgtaaagcagtggtctccatacttttcagttcatgcacacctaaccataaaaaaaatgtgarcatgaacctatttacttataagttaagcattactgtaataaaaaatatataatctatgtatacagtatatttatatacatacatrtatcataaaatctaacattgaaaaaagggaaaattttaaagaataaaatgaaaaggaaaacttcccatatcccattgaattgtcttgagtacccctaggccatagcagtagtagctatgaagggcaaagctttagaagtgtgtcacgactggaataatgattagagacccccggcaccatagaactaaaggctctgataaggtgcctggaatccttataacagcatggggaccctccaaatgaagaaagggagtcatgcagcaaatattggtgtaataagtaaatgatttcactgatttttgaaggaaataaggtttgtgagtttcaaagaaaagrctaatcttatactaaatatttatgtctaaggttcctcaattgcaaatgcaagttttgacctttatgccaaacaaagtcctgcaatttacaattttattgatggaattaactctttccttccttaggatgctattgataatagattagattcaaaagaatggccatattgttcccagtgtccagcartatggaatggttcaggagctgtaaggtaaattctacaagtgaaaatcaatgaaattttcattctacggactaataatttaaaatggtacacagatactcatatttggcaactttctttcaagtatataatcctgtattttttctttaactgtaacttgttttaaatgaatccagataagcaatatgaaaatgtactttattataaaaaatattttcatgaaacaagaagtatttccttccccacctcctcttccttcacatagcagagaccttaatcctttttgataattayttttgtgttgaggtactttaaacatttaaaaagatacagagaatgttacaatgcatacccttatgcccagtgcccagcttattaactaaatcattataattcaagcttcctgtatatcacactatggttttattattttcccttattttctgtcctgaatttggtgtttattgcctgtatgtctttatactttttctacatatgtttgtatcctaaacagtgtcttgagttrtatcttgcaggatttcctcttgatctttggctttcagcctttaactrtgttgtgtctaggtatagttctctttgtgtttattctacctgaggattgttgagtttcttaaatctgcaagttaataattttcatcaaatttgggaagttttcaggcattatttttttcaaatatttttctgctcctttctctctccttcctttctttctgaaactcctgttacacataagttggagggtttgacattgtcctgtgagttactgaggctcttttctttcatctttttaaaatttgttattgtactttcacatgtagaatttccatttgatttttttaaatttccatttctgactgttgagattccctgttgttaacttgttaccatatttttctttttaattcttttgatcatatttrtaattgcttggaagtccctaacatctgagtctactcagggttaattcctactgaatgtttttttttcccccaagtatgagtcacacattcctgtttctttgtatatctactaatttttggttgaaaattggaccttttagataatgtattatagcaactccaaattgttttagtaatttgtgtggactttgaactatggaatctttctctcttgctctcttgtagccactgatgtccttgttgagtttttaaaattttttaattttttatcttagcttctagtggttgcccctatgtctgtgtagtttagaggtcagtcagttatctgttcagacacttcaagcctgtatggcttccatcctctactgatcaagctgagtgtgggttaggggttgcattccaaaataggcagttcttaagtctccctcctttttttaattttttttttttttttaaatagaggcaaggcctctctctgttgcccacactggagtgcaggagtgcagtggcatgatcgtagcttactataaactcaaacgcatgggctcaggtgagcctcccacctcagcctcccaggtagctaaggttccaggtatatgccaccacacccagctaatttttaaatgtcttgtagagacagggtctcactatgttgcccaggctggtcttgaactcctgggctcaagcgatcttcctgcctcagcctcccaaagcactgggattatagatgtgagacactgcagccagcccttttttccctcattttttttcctggactttctcaggttttccccacacatgcatagtttagcagtcaactaatgatgtgtagagagcttatcttttctttctttggcttctttacttctgggatttccttattaaatttctacctggccgggtgcggtggctcatgcctgtaatcccagcactttgggaggccgaggcgggcagatcacttgaggtcaggagttcgagaccagcctgatcaacatagtgaaaccccatctctactaaaaatacaaaaattagccrggcatggtggcacactcctgtaatcccagctattcaggaggctgargcaggagaatcgcttgaacctgggaggtggaggttgcagtgagccaagatcatgccactgcactccagcctaggtgacagagcaagactccacctcaaattaattaattaattwatttatttatttgtacctgattggctgcccatcctaagttgagaccacacctagcaaagctgcaggattttgtactcgcctcactgccccaccttgaatcaagtcttccaccaatgcagtaaagctataacttttatctgactgagctgggagagcagtgagggttagatgcagcccaggctagaaggttacatattcaccaccaccgttcttaccagatatgttagcagatattcaagattaaatgcttctcaatttgttgtctgcctatggtttccagttaacctgaaatgttttgttttgttttccccacaatttcatccaggaatatacttgttttcttagaggggaatctcctgaccaccttattctgccatgaccacaagtgctctctatcttatgtttttaaacttaatatagtgtcatattgtgtgtcctcctgcagcctgcttttttgtttctgtcacattatgtttgtgaaatttatcccagactgatacatgcataaattttcactgctagttggtatatagttatatgagtatagcaacttattcatctgttttccacatgatagaaatttaggctatctcaaaactggcattattacaaacagtatgcagtgagcattcttgtacttttacgtatatctggatagggtgcttcccttggactgagkacttttctttacttttgttttattttttccttttctacaaaaggtttggaggttatgttatctatttttattcttgtagcagtttattactaagcatatttgactcaacaaagtckaagattaattagtatctctgccctcctcttgaacaatacaagaaccttagaccaactggatgtaaaccatgcaccccttaaatgttataatacttcatttgtgttcactttgtatcttttttaccccccatattactaagcagcattattggttttttaaaattcagttgtatgtgcatgtgaacctgttaaatcgcccaccacccctttcgtgtgggctcagtttctttctttctgaagtgtatcctttgatgcgggtctgttggtggtagtcttttttattttttatttttttccaagacagagtcttgctctgtcatccaggccgcagtgcrgtggcacgatctcggctcactacaacctgtgcctcccggactcaagcagtcctcgtgtctcagcctcctgactagctgggattacagatgtgcaccaccacaccctgctgatttttgtatttttagcagagacagggtttcaccatgttgtccaggctggtctcaaactcctgacctttgatctacgcacctcggcctcccaaagtgctgggattacaggtgtgcgccactacgcctggccagcggtggtartctttacagttttatccgtttcttcatttggtcgttgttcttagccagctatgaatttctaagagctgagttatgttcagtcaacacttgtagaaaatattctgctgtttccagggttctactttagctcttgggaaggtggagggggttgtgttttctgtcagtcttgtacctttgtraataattaaccttttttctctggttgttttttgtcctcggttctgtatattctctgtgctatgtgtatctgaggatttatttttatttctttctttggaattcatttatgtttcctgaatctgaggatttacatctttcataaattcttcaaatattgccacttctgtagtcttggttttgttagaacatcttattctgtcataatgtctcttaatttcttaaacttttttgtttcttctgctggtgtttcattctagaaatttttcttcagatttagttttcagttctttaggtctctcttacactgtgtctcatctgctgtataagctgttttttctttttctattttcagtgactttatttttctgttttagaagttctcatgtttcttttttaaacatgcttggactttttgttatttcttattttgtcatactctctatcctcctttattgtctattgtcattttaaacatacytaatttgtagtctatatctaataaattcactaatttatactctttgggttcaattctgttgccttttatttctgcagactcatagttacttatttcagtatgtgtcttgtaattttgaatgctgagtttatttcagtagccagcattgagaacgcatcccttcargcaggttttgcatgtgcttttgccagattagaggttttttcttttttgtattaatgtctcagtttggggttcctcagaccatgaaggtagtatgattaatacctaagactctgtgagacaggcctgtggctaaattatcagaggagaagcttccttgcatctccccttgcctttgaggttgtcctgaccttatgcagggtgtcagctcccaatctgtaccttgcacagtacccagggctcggccccttgtttgctaasatcagaaaatactccacaaggcagaccaagcctcaactcagtttaccattctagtatttagcttcctttttaccaatagccctggagatttctctgacttgtttactctcagctatgctttaaaaacatgtttcctcttaatcagtgctccttggtgctatttagagggaagttttcaggatctagggatttaattatctttatatctctcagtcttcacatgtgtgtgaaacaaattaaatataatcccgttactctaaaattgctattcagaagcttagaaattgttagaattgttttgagcagtgttgtctccttttcttttgccttcttactctatttctctctgttgaaacagttcttaagccaaagttattaatacgtccttgactttgggaacaagagtgggtcttgttcctgtttcatctttcaaaaggaaaggaaatttttaattttagtttttaaaatttgtttcctgttgttcactgcctcattctttaaggtaatgaatggaagcaatcatctgaaaggctagattcagatttttttttttttttttttttttgagacggagtctcgctctgtcacccaggctagagtccagtggtgtgatcttggctcactgcaacctccacctcccaggttcaagcgattcttctgcctcagtttcctgagtaactgggactacaggcatgcgccaccatgcccagctaatttttgtatttttagtagagagggggtttcaccatgttggccagaatggtctcgatctcttgacttcatgatccgcccacctcggcctcccgaagtgctgggattacagacgtgagccaccacgcccagccaagaacattattaaaagtttgctatggggctgggtgccgtggtgcacccctgtaagtccacctacttgaggctgaggtgggaggattgcttgagcctaagagttcgaggctgtagtgccctgtgatgatgctggtccgcagctgctgcactgtagcctaggcaacatagcaagaccccatctctaacaaaacaaaaatttgctatgagatcctatactgcaaggcattctaggtcatccagaacagtggctctcaaagtaggtaacaaaatgaacaattgggtacttatttttacctaaaaaagaagaaattaagttttactaatatatactagtacacatatgtcatttacacattaatatatttgtttataaatgaatgtttattttgaaatatttacttttcaaataaaagctaaaaatttttaccagtggagcttgtgaacaaaaaaagtaattcctatgctctagagcagtgctagccaatagaactttctgcagtgatagaaaggttctatattggcactgtccagtatgacagccactagctacatgtggcttttgggtactggatatgtggctaagtatggatgaagaactgaatttcttatttcatttaatttcaactaatttaaatttaaatagcctcatgtggctagtggctactatatgggaytctggggatctagagcaatctggaggaggaatggtaaaagtaatgactactatttattgagtacttacccaacaccagattctgtacttagtgtgttctgtacattgtttcatttcatccttgtaacagcctttgaggtttagagagaagttaagtaattttctgaaagtcatactgaatcaaaaacaagcagaataaaaatcgaaacacaggtctaattcttaacagccaacctcctaccatcgtaggttcctgaattccattccatcaaggaacaacctaatactatatcagctccaaagtattacttgcccctttccccttcacatcttcaaaacctttttcagtgccactctctaatttttttttaatttcaagaagctgcagacttctcaggtatattatttcttcttatgaaataataagggaggttgttagctctactctatatgttaaaatgccaagccagattatgcatgatttgttagaattgtttttgaaatgtggctgtcctgcttaagtcttggttagtcatactatggttaagtcatttccttaaaaatcaatgtaattgggccgggcgcggtggcttatgcctgttatcccagcactttgggaggccaaggtaggcagatcacgaggtcaggagttcaagaccagcgtggccaacatggtgaaaccctgtctctactaaaaatacaaaaattagctgggcatggtggcacatgcctgtaatcctagctactcgggaggctgaaacaggagaattgcttgaactgtgacccaggaggcggaggttgcagtgaaccaagatcgctccactgcagtccagcctgggctacaaagtgagactccacctcaaaaaaaaaaaaaaaaaaaaaaaatcaatgtaattggtagcaagtttgagtttggttgagttaggctttttaagtctacaagcattatggctttggaaatgtttataacatgtttacttttttttttttaaattactttttagtgctcgccagaaacccagagctaattatttagaagaccgaaaaaatgggtcaaagctgattgtttttgtaattggagggatcacatactctgaagtgcgtkgtgcttatgaagtttctcaggcacataaatcctgtgaagttattattggtaagactttcattttcttcttttctgtttttttttttttttttgagactaagtctcggtcttgtcccccaggctggagtggaatggcgcaatcttggctcaccgcaacctccgcctcccaggttcaagcgattcttctgcctcagcctcctgaatagctggaattacaggtgtctgccaccacgcctggctaatttttgtatttttagtagagacagggtttcaccatgttggccaggctggtctcaaactcctgaccttaggtgatccgcccgcctcggcctcccaaagtgctgggattacagacatgagccaccgcacccagccttcttttctgtttttaaacaaactctaaatgcaaaagtatacatgtaaaatgttatcttgtgttatacatttgagacaaaatttaatgcaaaaaaattgttaaccatagaatgtgttttgtctgatgtgctggagttttttcctagttgactttttgatagttttattttaaaatgtgcttatttgaggaaaaggagcttgctcctttaaaatagtatgttctgtacgtttgtttaaccattaaatagtttttgaggcacaaatacatttctacttcaaaaatattttgaattttttgtggatatggacatkacattggcaaggcctgtgtggaattaagttttaagaatttcaggccaggctagtggctcaggcctgtaattccagcactttgggaggccaaagcagaagggtcacttgaggccaggagtttgaaaccagcctgggcaataaagcaaaactccgtctctacaaaaaattaaaaaataagaatttcagtcaaagccaatgataggtaaactctcctgacccatggaggcgatggatctgtgtgttaagccttgacctgcagcactgcttagtggatctctattattgaacaataactgttatagtgctgaggataggataatcccgttttgcccttcattataccaacgtatagcacaaagtagacaaagcactaggaatggccgctgtttctgaaaagttactgaacatgctcagtggtgaagaaggattgaaatattgcagcataggcagatttcaggaagatgtcttacagaaattttgttacattaccccaggctactgcactttacatatttgaaggacaacacattatattaagcgaaggaaaattgatttaactgctggcctctgaaaaattctcttttctcctaccaggttctacacatgttttaacacccaaaaagctgttggatgatataaagatgctgaataaacccaaggataaagtctccttaattaaagatgaatagcrtttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaattattctggtttgtgttttctgtaggggagaggggaaagttacaaattttaaaagttctaaattagagtaacaaagaagaaaaggaatctaccgtaatattcccaccaagataactcctaatgactttttcaaaaataacgtaatctctatatagggttagataatatatgtctgcagatgtgttttgttaaacaaagggaacatctttgtttcaaatctcttcttttacttgccctcatagtgttctgtcatatggcagaccatagttttattgattcagagttttgctcttataaataatgctgcgttgtttgggtacatacctttgcagacttacacagacatttccataatgtaaattcctagcagtggtcaagggatttgtgcatttaaatattgatggatatccatttttaatttttatttaagtaaatccatcgcttttccattttggcttctgaatttcacatgctacttagaaataccttccacactccaggattataaatttttgatagattcattctatttttttacaggtaactcacccatctggaattgattttagtgtaagaatgtgtgctagatattgtctcttagtacttggcatgacgtcccatgcctccttaccccataccacaggggatgaaaggctaaacatgaagtttttcaggttctaggataagtaaggtctgaacagtttatattctaccaatgatgtgcacttggtcaagatttggaggcagaggccatctactatgccagtaagcaatctcccgcagacaggaattgtttgtagcaaccagactccacattttagtgtcttgtcgcctgcttcgtgggtatgagttaatgctgtggcagcagcactagcttcctgtcctttgggtcacagatggtaaaatgatcgtgggtctccagtttctgctcctactgctttttcagtgatttttgtaacgacctaattctctgtattaaatgcctttctgcttgaaatatctagagaagtttgtttcctgcacagaaccctgacttgatggagtatttcatagtggtccagcttcactcctttctaaacagccagatgttataccagatcctattggataatctctctttccccaactaatctgaaataccaccattatcatagactaaatttccatttgtattgtggtctatttctggattctcttttaatgacctacagtttgttttgtatttctttttccctatttcaattcatggtatgtttcaatatgtagtggaagaagttcctattcaatccacctaaattactattatttttcagaaattttctatcagatttttctagatgaattttagtatccttttgttgagttcccaaaaaaagccattttggtattttcataggatttgcattgttcctaggttaacttaggaaaaatcaacatcttttataatattgaaactttgatattcaggaatgtgaaatgtcttttcatttaaatcttcataaccttcagaatcttcattttcttcatatagttactgcacattgtcaaaatatttttgtagttcctttgtgggttgaatcttctactattttcaaatggttttttacacatagaaatttatttatttttttttaaatagagacagggtcttgctatgttacccaggctggagtgcagtcatgtgatcatagctcactggaattttgaactcctgggcgatagtgatcttcctgcctcagcctcccaagtagccaggactacaggtatgggccaccacatatggctaatttttgggtttttttgtttttgtttttgtttttttgtatagacagtctcactgtgttgccctggctggtctcaaactcctgggcttaagcaatcctccttctcagcctcccaaagtgtggggattacaggtgtgagccattgtgcctggccaacttttgatatgttaatcttacaactttactaagtattgataataaagtaataatatacaaatgcttacttagtgctttctattattaattcattccatcttctcgtgtattcctgtgagcataggtactgtgattatcatctttattttaaagctgaggaaaccgacacaaagagatggatgtaacttggtgtggatgagtgcatggaaaggaagggcctggcacaataaacagccctctttgcaaactacgcatgaaaacaatatatctccagtaagaggattagtttttggtgtctgcattttatctgagatctttgtgtgcctcagtaactccctctccagggtcagaacatgtgtggaataggtatttagattaatccaatggcctggaacaaatggaactaagagtgtgatgacagcaaacactggactgtttattcatttgatcacttgacatctcagtgaccactttaccctgatcacactgatatcggatgttttgagtcctgtatttcacatatatgttaagctttgaattgcagagaccctttgtttacaaaatctcttatgaatttgaagccataagacgtcatctcacataaattccttgtataagctgattttttttcccccatagaattagcaattacaggccaaagcaggaggatcacttgagcccaggagtttgagacgagcctgagcaacatagtgagaccacatcttttttttttttttttcgttctatgaatattccaaaagtgagaccacatctttacaaaaaaaggaaaaaaaaaaaagctgggtgtggtgacacgtacctgtgatcccagctactactcaagaggctgaggcaggaggattgcttgaaccaaggaggtggaggctgcagtgaactgtgatcacaccactgcacttcagcctgggcgagtcagtccctgtctgaaaaaaaaaaattacaggttttgatttcaagacccagaaaaagacttttttgttgttgcaaccaatggaaaccatttattcactgtctctgaaacacagatttgcttcctgttgaaatgtgctttatttataaagtacagtggattcacattcttcaatcatattagtaaataaataaggatatctttattaatcctgttatcctggttcctagacccttagcctttactgctccaggatcacaataggagttcacaagatctcaaaagtcttggatttgagccccaaagggcctgaccccacagtttattgtgtaagatacgacacctccataactcagttcttccctaggtatttgtacccattgtaagtcctattggaatgcaagcagatttcttctaaaatcaaaggagcaagaaatgtcttccttctataggaaaatttttaacaccaaaacaatgttttttctattaaatataaacacatattcgtatttagtacaaattaggcctattttatataattcattaacagcaagattataataggataaaaagatgagatttcttttgcaaactataatagttaactaaaggggatggctagaactttgtcttaaagatgataggccgggcgcagtggctcacgcctgtaatcccagcactttggaaggccgaggcaggcagatcacctgaggtcagggattggagaccagcctgaccaacatggtgaaatcccatctctactaaaaatacaaaaattagctgggtgtggtggtgggtgcctataatccctcgggaggctgaggcaggagaatcacttgaacctgggaggcagagattgcagtgagccgagatcccgcaattgcactccagcctgggcgacagagtgagactccgtctcaaaaaaaataaaaataaaaaaaaataataaaaagatgataaaaagccctctatagacagtcccattgcatcctgctggcagcttccagcggccagagcacagctagaccttggagtaaatactgagaggcctgtgcaccctggagactgccaggtgtttctttacagccctcaggcaatgctgagtcccttgatgccagcattaggggtaccattacttttacttcacaagcttgtttttctggtttattactcgaacagaattagaagagaggtcattagaattgacacaagaattgcatgagggaggagatggccaagactacaggatcagtaagtataaaattatccttgtaaatcagagcctagtgtctttgtggaactccttaagggcattgcctgcccttttttgctatttcttagattagtcgtgttgcagtgattgctcataatgacccctaatcttcaaggaaatggaaaattacatttagaatatggtttgataaagcagaaatgggccatatttttaaatcaaaaatgattataattaccaatttctataaatgttaatttgagggatttagaaatattcgttaatggtagacgtttctaaccaaggttccatggatttgtttcatggtgtccacgaacttttaaaaatgaatgtattcttttccacgagaaggcagagcatgggggaagggagactccatagctttcaccagattcccaaaaaatgagcccaaaaaaggttaagaactaatgaatcatataagaacacttcaagccagagaagtatatgattttaaacttggggatgagatagtggtactaacatacaaaacagattagcaagttgtgattaaatttagatatgtgatgatactggaagcctcttggaactgccaaaaaccaaaatgtcaacaaattaagtctaatgacctaattggcttttattagcaatttatgaatcaggcagcatcctatctatgaaatagaaaggctgagcacaggagtgggctttataggcagaaaaaaacagaagaaaatggaaacaaggaacaaaaggtgtctttatatgggttaaagcagaggggacttccttatgccagctcaggttgacggggccccttctaatgggatactgtgaatgttctgggtcttttttttttcttttaaactgacctattttaaagttcagtttgattacgtggcacctagcatgagtgactccattctagtttggtctggtctgttggggtcccctgtaggagcttagtccaaaaaaatgacctcccataagttttatttaatagaacatacacagtttaagctctgttttttctaataccagccatggttccttgctatcttccttacagtgccacagcctgaagtaaatttggccataaagtcagaggtattttcagactgacctgtgcattatctcttccagggcaccctaaaccaatttacaaaccccaaagttaaaaacagtccattctccagccagctagacgaataccagctgctcacattggcacgaaaatctaaagtgggaatagattcaactccctcctgaccactgagccaaactctgggagttgggaaaccatttgttgaatgtctagggtgaatgaaaatcagaagtttcagggaagggggaaagagccaataccctgctgtgctgtcactaaggaggtaataaatcactcttaaagaaggaaagcaaaagcttgatctggaaggaaaaaaaaaaaagcctgctctggtctgcatgaaaatgtacttaatctctggtacacagttttaatgaattgtcttttccaaaatttcattaaggctattattttcacatatttctgacttcaagcgatctttaaacaaataattttgacttataagtatattgtgagaatttcatatagtacagaaaagaaggtaaaaacccctttctcccccaaaactcccagtttcctttactagaggttcacttcagatttttaggtatctttcctgaaaatacgtatgccctttaaaaaaaaatacacaaatgaagagccaggcacattggtgtgtgcctgtagtcccagccactcagtaggctaaggcgggaggattgcttgaagttcaagtccagcctgggcaacatagaaagaccccagaggttacaactctctatatatatgcttaggcatcttgcttctttcactgacttttgca

SEQ ID NO: 12461 - DNA, 19670 bp, Homo sapiens
  misc_feature (1)...(19670): n = A,T,C or G, or insertion/deletion polymorphism (see Tables 1-2)
ggaaacagtgccaggcggccagggccgtgcccggatgattcgacttggagagggggtaggtgttggagaactggccagaaccaggcgtttccagggaggggaagccccaggctgcactaggttggggaggccatgccccctcaggcctgatgggctggaggctccgggcaggtggagtggctggactgacctcgtcacccaggccagtatgtgggcaccaggggcccgtgaggagaagcaggaagggctctgcctttgaccttggacatgggatggacaacttggaggatggctttgtgatttgggaacagaggggactagaaattggccacatggggccctggtggtgggtctggcgatgcctggccctgctgtggccgccagcccctgccctctctcacctgagcccctggttctttggccttccagctggaagacctgaacttccctgagatcaaacgaaggaagatggctgacaggaaggatgaggacaggaagcaatttaaagacctctttgacctgaacagctctgaagaggacgacaccgagggattctcggagagaggtggggcctgcgtggtgctcccaggggaagggtgggcctggagggctctgctggacttcccagagccacgagggccacctgtacccatcctgcagggggctcaccagtctctggcccagctggggccaacctcagtgttgccaggcttctggtgccagcgccttccctccttgaagtgaaggcctactgggattggtaactctgtccccaggcctgtgacctcccagttcctccccagggctcctctccacctgctggaagtcagcggagggaagggtgttgggagcctggccaccctcctgcccccactgtgactttgctggtggaccctgtgggtgggagtcatatggactctgcttcttgttcctcagggatactgaggcccctgagcactcggcatggggtggaagacgatgaagaggacgaggaggagggcgaggaggacagcagcaactcggagggtgaatggtcttggggtgagagggtgtggccctgtgagcccatctggcgggagggcagagccacgtgggcggggggcgtggggctctgggccaggcttttccctccctgggaaggccaggccaaatgctctgttctctggcagccagcaacagggataaattaattagtgccgtgattaattagtgatgagtaacctccaaggctggcttcttcctgataaagcaaaatttatgtagcctccatctctccccgcagatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttgagtggtggctcctggagatttgtgtggccccacccctacccccggcaacctcaacacagaggctgggaagggtcgggggcccctggaagtagagccaaggtcccattctcctgcttgggtgaagtttgaccggcaagggcgtggccccctccatagggggacgtggccgtcgtgggggacaagggctgctctcctgtgccgagttctcgctccggggcccgcagggttggtggctgcagtggcagagccacggggaagctggccacgtagaaaactcggcccaggcgcctggccacctgcagagagatggcctggtgggggctgtcgcacacccacccagagctttctgcccagctgtggtctggagaccctgacctcactccccagcgtctcacctgggcccggatcttgagggcgggccccagcttcagccccatgttggtcagcaggtgctcctccgtcagcagtggcagggtctccccgtcgatcccctgctccctgaagacctggaagggggagggagggagggtcaggacccgggtgctgctccatcctccagcccagcagagccaagaggagctgtttgtgcagctcacggaaattttttaaaaacagtgatctgttgggtttgagtgtcaggcagaaaacacctggcaaaaaaaaaaaaaaaaaaaggtggggtgcacagtccagtccctgctgcgcactgcttttggggagggagagggcgttggggaatggccctaccccaccatcctttccagggaggtagtgactgccagccagctccagccccgccccaggaactggggcccccccttacccgagtgtactctccacagccagacaggccccccacgaagctgcagacgtcatccacggtccacttggtgacgtcctcaggggctggggcctcctccccatccatggagagtccccctaccgcgcctgagttgtggggcgtgttactagggctctggctggctttcccatacccgcccgtctcctgaccgtcgtgtgccccaattgctgaggtgggggatgggtgcctaaggggaatttttcctccccccaagacccttccacaggcggcctgccagtcctgtgccctctggaaggatctagagtgtgggggtgcccacctgtgtggaagtaggggctgacggcataagggaagcccaggggcagtgtggaccctgggaaaagccccttcccctcggcgccggcccctccagctggagcttggcccggagtgggccccctgcacccaacagctgccgtctcggggtcctctccgtccgagtctttggggggctcgtcttccgagccatcttgtgcccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgaggaatcctgcctcctttcccggcgcccccacccacctctagcccgaaagccaatctcccctgccaggcgggcggctggggcctgggaggctgagtgcagcgggcagggggtccgagtgcatcccggagggacccctggagaacgtcctgaggtggggtggacagggtcagggccgacccgggggaaggggcagcccctccagctggcgtctcttcagcacctggggagtcctggtggccaagtgcccactgcacccagcccggcctttctgctcactgcccctccccaggctcctggggcaggcgtctggctgcatagacgactcacagaccacagggtccaggagcttgctctcctcggggggtgctgctgacatgcccactgcccaccctcacctgggtccaccccagactccatttctctctatataaaatgtgagctagtcatgaccctggggacctaggggacatggaggtgtggcccgccccagggggcatggggcaggacgtgtggcagagggacctgcatccagcctggccttggtgtcagcagggcctcagcaacaggaatggccgagtacatgtggctggggaggtgatgaggggagatcatgccagggtgggtcctcaccgtggctggggaggtgatgagggggatcatgccagggtgggtcctcaccgtggctggggaggcccaggtggtagaggcgctgagggtcctcaaaggtgctggcctcgctcagtgctgacacaagccggcggtaatggtcctccggggccatgctgggccccagctcccgcggcagcagcagcgcctctgctggggaggacccggggtgagaggtttctccaggcactgccgaggaccacgcccctctagagtgcctgctcgaggtccaggggaccctcagggactgccccctcccctggtgacctgtctctcgtcccagccacgctcttaccttgaggcgattcgcttcgtgccctcttctctgaaaagcagtcgctgctgatacggggggagcggcccagcctcttgcccaacaggtcacctgcgggagggtagtgagtgcccacctgcatctcaaggaatggaaggggaacccagcccctgctccagctcagcctggaccgcacccaccatctctcagggggcccttggtcctggtgagtacaggccttgcccagccctggcagccccagccttcagcgcagaggacatcacgcctggctgtggcgggacaggggcacaggggagctctgacactggccctggtgcgtgtgtgcagaagagatccacagcaggcacccagctgccccacccgccatctagcctcttgtgcaagttaacgagcccccctctcatccccctagaggagaataaaaagcttttggtttgaccaggcaccaccttcccctcctggacaggagtgagggcgggctgtgcagggtcacatgccagcgtggggtgagacaagccgggaaggacctcacacctgacctcttgctgctctgtgagtcactgggctgtgggccccccaggccgcctcgaggcgcctccactcccaggcctcctacttggtcatacccatccctgcccccagaaggcccacgtcctcctctctggcccagtcctgcctgagctagcaccctggcgtggctgtcatgcccttgtccaccagcccagccaggctctgggcttctggggtgcacctcccagtagcttcacccacctcctcagccacgaggccagcccagccctagccccaaacacagcccagcaggtggcagaggggaggcccaggccaggtccagcttcagccccaaacacagcccagcaggtggcagaggggaggcccaggccaggcccagctcactctcctgaggtcctcccttgggtcctgccgaccgcamccattccagaccacaccatccatgtacccatctccgacccaccccgagctcctccgaagcccctgactccacgccctgggggtctcccaggccagccagtgcctccgactctggcccttcctcatcctcatgagggctctagctgggtggagtgaggggccacycccctgtgacccaagacctccatgaggcctaggcagtggggctcccaagcccgtccccccacaagccctgccgtcagctccaggcctaattcctttttcttattcccttaatctgtcatttttatcaggctggggaagtgcggcggccacaccgatcaatcccacattacagctgacagagtggtgctaataacttattgatcctggcccggctgctgtcaggcccggccccagagagagggtcagtcccacggtctggtccagggtccccacctcggtgacagatcgggtggctgggcccggcgggcggcggggggcacctggccacacacggatccaggcaccactgctcaggcccctgagaagccatcgtctcccccacagcctcccgtgccagagctcggtgggctgggagggggtgggccaaggctgggggaacctggctcttttccacacctgccacctggcccaccatgcacatgccctcagggttagcaaggcctctcacctcctggcaatcacttttccattgtacacagtggaaactaccctctccgttctgtggggggctaaggcctcctcctagcctgggggaggtgactgggtgggggggggcaggtggaagggggcctgcaatgagaccgcaggaaggccgatgaggccatgctcactcctcactcatggaccccagcgggtctcacagaggcagatgcaggacctgctctgagtccctcacagcccagggcccagggaggtgcggcttagcgggagggcccgggctgggaacaggatggatgtgtggttcctggggtcacaggaagggagaagaggtgaacgccccccagggtgaatgcccctccaagaggaggctccggggagcgggccagaccctgacacggagtgcgtatgggagacctggacacgggtccaggacacgtgaggccccgtagagcctgtgagcccggaagtgcacgaacacgtcctgactccatgggtgagagctgccgggcaacccccatcacgtgcaccccacaggaccscagacacagacatgccggcacacgcacacgcgtgtacctgaggaggtctccctgtgtgaaggcacaggggagggcctgctggctcagaatatctcaatcattgtggggctccctccgctctgctggatcgatggggcaattagattttatcaaccgcctctcagctgtctccaacgcggcatcagaagctgcccccacccagccccacaagggccttcctaggtgcacgaggacgcggatgggggccatggatgggggacacagatgggggtgggcctcccccacccctccttcccaagagatgcaggccctgctgggaacacccctgcctggggtccacagggcctcggggcgcccccgcctcctttcacggcctgccctggggctgaggctctgctgtgcccctctctacagcagtgccctctgaggggggcctggtccccccacaactgtgaccaggcagcagcacctccctcaggcgccggatcccttccctcccgagaaccccatccttcccggagccctagaaggcgggaccgaccggggaccccctccgtccaggagccctaggaggcgggaccggggaccccttccgtccaggagccctaggaggcgggaccggggaccccttccgtccaggagccctaggaggcgggacggggaccccttccgtccaggagccctaggaggcgggaccggggaccccytccgtccaggagccctaggaggcgggaccggggaccccttccgtccaggagccctaggaggcgggaccagtcatgcgtgcgctgcgggagtgcgtgcgttcctccagggtgtgcgtttctgaacctctgaggccacgcctacgtctgccctgtggaaagggggtggcagggccccggctactccaagcccaccccagcggcagccacagcggagccaccgcctctgcctcctgtctgccccgctggctgggattaacacaattaccatcccatgcagcccctgggggacaggccgctcctcctgcctctctggctgcctgccaaggctgctggtgctgagtggagacgmcaccgtcctctggccccacagccccgaccccgccctcaggccccctgtgctcctcaccggcgggtcgcaggccaatctccaggctgcctctctggaattcacagcggctctgatgctcsggcataacgaggtggcggctgcggtggacgctggatatgagggtgggaaggttgccgtcctggctgcagaacgagaccgggaaaagctgaccccgtgggcagctgcgaggctggagcccagcctgggcacagggagtgcctagctctgtgtgtgagcgtggggatgacctctgagtgccacgttgctgtgcccacgcctcggcatgtggcccgtgacgccactgtgtgcacacccacgcagcacccgagtcaaagcgacacagaacctggcactgggacctgggacccyacggctgctccagggagggtctrtgtggagcagccagccggctctgccttcaygccctccacagggaatcacagttatctcactccctgcctcaaagggggtcgaggggcccacygggcgcccrggaagaggccgatctgctcaggggcagtcctgcaggacaggccccaggagagaatgtgccacatgtgaaccatcccctgacccccgatttctgcacacgaggaaactgaggcccagaccacagtcctgcagctgatgagacgcgccccacgcacacacggcaccggcagacacgtgcagctcgcaccaggcaccagggctgcgtgctccaacctcccgctgtccccccggcaggcgggggcttggaatcaacatgcatttaactcttttcttccctcatttctcctcttcttgctaattcagcccaatcccacatccacagagtcccagagagcaatgagacgaactgtgtggagcacggccctccaccccttcccggttccgtgagcctnnnnnnnnnnnnnnnnnnnnagtctctgtggtggggccgggctgcaggtcaggaggtggggaagctgggagaagcagtcagggctggggcaggaggcgcaggaaggagaaggggagggggaggccagagcctggcaggtgtgaccccagctgcccacgcatgggcctcccgccaccgcccctcaktgatgaccacacggcctagcccttgcccattttcccaccagctcaggggcccaggagagaggggccaagcccccgcctgcaaacaatggctcgaggagcatctgccaccccgggttcctgaggcagaggaggacggcctggggctccgctggctccaaaaggcaggtggtcactgcagagccagccagacagggcgaaggggatggaaggacagayggacagatgggtggagrccactggacgggagcaaatgaacacacagatggaggtggcctggcagtgtgttctgtgggagcctgcagaggcagaaggacccagggacaggctgaaacacagacatggtctgggagcccgtgtgggttcagggaccaccacccgctctgaccggacaccagggtcaggtcaacaggcggaggcttcagtccactcaggcgtgtgctgggccttctcctccggggaccccagcacgccctcccctctgaccgaaatctcgcccttgggagattcagaaactcatcctagccccttctagggcccgtgcaggatggaagacctggcctcttcctagggcaccccaggctgtctgccgtcagtgctgccgagggacgctgcattcccgaggccaggcagacggaggagggggctgcaggcaggaggagccgttactggagcggggtcggggggaccgcggctgggtttccctacaggcctcgctgacaaatgtattctgtagtgtcccawgtaaaaggctcataaaatgtcatcagtgttcatgacagttcataaaaatgatcaggtgagctggcaaccccaaaatgaggtagaaataagtttaaagatgtttttattgtaattcggctctgagatccagacattctcagagacataaataataacacatctggcgtggagccaagacacgcaggtcccctgggccttcacggctctggccccaggaagctggccttgtggcagacgcctccttcctgccttgctgccctggaagccacagggtgagacctgaccccattgacagaatccacagctgggctctgttcacagacttaccactcgcttccccctggagccaggaactcgggtcccccaactcccttgacctcttccccggggctcttcatttttatctcctttccacatcctggaatcacaccccctaccgtcctgcttccacagcctgaatccaatcccctgtctgccaggaaggcctccagagggaccttctccaaacatacacctggtcactgccctgctcaagaactttcggtggctcccgcctggaggacggtgcccacaggcccagcatccatgactcttcagcatccaactgaaccagagctgccaggttcactcctcgtccctcctacacgcccttccctgttcctcyactctgcagacatcccctcgccttagrgctcctacacacccttcagggccccactcacacatcagcattctcacctccttgtgggtctctaggagggtgggaagggggaggtgacagcctcatttttgggctcaaatggccagtctcacatgggaggaagtgcactctaactccagggccgggctgcccagaactcacacctgagctgctgccgagagctgcatctgactgggtctggggtccctcagtcccaactgggtgcaacactgtctgcctcccgggatgggggacaaccttgcagcacatgtcaaacctggcagacactcagccagcatcacagcatcagctcacgctgagacagcggacagcagacagcagggcacggtcaggggtgggagggagggaggggagtcacggccccctcttatgcacgcacagcacggctcctacctgcaggacgcctctcggaaagagatgttcacgtcccagtgggtgtggactctgcaggaagggaagcagaaggtccatgttgctctggaggcccctgaccccagcctcaggatagcagggcgtgcgcagacctgtctcgggtcagtgccctgctgggccacagccctgggcagtgaacgagggcggctgccatgcccagcaccacctgctactggctcaacatgctggggcctcccactaggacaggcccatgggccaaagccagctcctggcctcagcagacacgcatcaggaagaacaggaccgaggccccttctccctcttgcttgttgccgtgcactcagaggagccctcctgttgtaccgcaggtgggggccgaggctgcttctgcacagccagtcacgagcctgaatggagctccctgttgctagagctgctctctggccagactgggacccggtcagcaagggtagctggagcgtcggcccaggaaggtgcagacctctgggtcccaactgctgccaacctgcctctgccagtgagcgccgcagagcagaggtgggaggggacgccagacagggggcagatgaggaaacagctcctgcctgcgacccacacaggaccccaaaaagaccagcatctgagggaaggtgtgggaggccggtgtggacactctcatctgagcagctgaaggcctgaagctccagccccatctgagccttgcgccttcctgtccggccctggtccaagtaccttctcttcatgatacggatgtgcggaccatcctcctgcttcaagcctggccgccgcccacaggtggggccactcccgtcgctgtcaccatcgctggcagagaagctgggagttcgctccttcttcaggttccgggcggcaggcagggcgactgtcctcttgtctgccagccgcccccggttctggtggggcaggaggagaggaaggtggggcaggaggagaggaaggtggggcaggaggagaggaaggtggggctggaccgggccgttccatctcccgggggtctgccctggtctcgcaccccaggccgagccccaagcacggcagaggtgccctcagagcagccatcctccctctacctgcctctgggatgcgcctggggccagcaggagccacagctggccagagacccagaggagagccgagagacggggccgcagttgggcatccccctacagacgacgcccactggctcagccctcccctgccccaccccacgccagcctggttggcccagcccttgaggatgctagagggtcctggccaactccagggcctgagtcggggccaccccatgtgcgacaggcctccgtcccgggcttgtgtggcccctcattcccagctcccttcttagggcccctgcgtgtctcctgggatctgcctgtggcctggggctggtgctggtggacgtgcactcaaatgcgcacgttccctccgtgtatctgcctgccaatcccacccgtactttgtgacccttctgcccaccacaccctgccactgatgccaacgttgacaagcgaatgcccttttctatttcatcagcgccacgcacagcccggctcaggggcagctgcagcctggtgcaaggccactggcaactgtctgagctgaaccctcgcagactgcaggccccggggctcacaggtcaccagacgaggagccctcaccagcccaggtcctccgttccgcaaaccctgccccgcatttctctcagggcttctttctcccatctcctttgcacccacggaacgagcgtgtggagctgtgggtgcctcgggtgggagcacagacacgcccgctgtggtccctgcagagcacagccgagccccgagctgacgcacacacgcggcggacgtgcccgcggcaccctgcacagcacaccagcgccggcccagccccaggcacttccggactcctccagtgtttctaggtcctgccacccccagggataaaggaaagttattgattattttccagtgggcgggaggcttttttaaatgtagtaacaggccgctggctccgggaggtggcagagcccttgagagcgtctaactcactccctcctccgttcagtcaccagggtctcctcagacttcctccctcccattgccacaacacagcccggagcttggggatgaggctgttaggagggtgtcctcctcagacctagaaccaccatcaccttcaaatgcacagccccagtgccagcttagtttgggcagtgccccctccccaagggtctggaagctggagcatccccccacccaggtggaggcccccgtcccagagccacgtctcccctcaccggccactgggcctgcgctgggtcccctctgctctctccacgacagctcactgggaaaacgcagcactgctgggcaaggggtggggcctggggtccgaggctgagaccctgccctgaccctgggctgcccccaacaccaatgaccacagagtgcggccaaggccgaaggtatgatgcctgtctgtgcccgggcctccgcgtgtcagctggagctcgggggtcccttcaacagccacagcctgtccggagtgtgctgtgctgggaagtcccgcttagctctgcccttctgcagcccaagcaccagggcttagaggctctgacagcctctcctctcccacctctcttcttttttagttttttgagacggagtctcactctgttgcccaggctggagtgcggtggcacaatctgggctcactgcaagctccgcctcccgggttcacgccattctcctgcctcagcctcccaagtagctgggactacaggcacccgccaccacgcccggctaattttttgtatttttagtagagacgggtttcaccgtgttagtcaggatggtctcgatctcctgaccttgtgatccgcccgcctcggcctcccaaagtgctgggattacaggcatgcgccaccacacccggcctcccacctcccttcttttgaggagaagacacaatgctttgctctctgcttcttgtctgtgggatggggaagagagggaagcaaggaccagaagactgccccttggaaggaggccagggctggctgggaatggagcccaggctgtataccagcctcagccccgtgatgcgcagagtcgggcgtggggacacaccggcaccccagccacgccccaaggcacctggagggcaggtctggagtggctgatgggggtgctgaggaccaggacagcttccctgccacccaccctgcccaaggacagaacacacctcctccacactagagacctcggccacagcacacagatctgaaaactcggcccctgacagcacctcctcttggaaggtgcttggcctgcagggcccctgtgcagggtccccaaggcacatacacactcatattctgccccggagcatctgtgaccatgaggtgcacatgcctgcggatttggcatggggcttgggggagacagcctctgagtaagaaacatgggggctggaaagaaggggcccctggagttgcttcctaggggaagggtgtgggacaggcctgggagggactggcagaggcaggcctggatctgagccatccctcacgcagggcagggacctgggagccccaggtgggggggcatctcctggctgtggccacggggtggggaggagatgctcacggaagcactgtcggaagagactgacgctgggctcaggctgtgtgctccccactcctgggggagccctcaagggggccgctcaaatccaaacagagacccaaggctaggcagcgggctgcccagaggagccctctccagcaccagctgcttgaaaggagggaactgggcctcttgccccgggtaggtctgtgacagcagacagggggctgccggctgtctgcacacctgcctgggaactctgtgagctgcctgcctgtgcgtgcaggtccatgtcggattgtgtgtcaggtgggcacatgggtgaggtgcggctgtgtccccttcccctgcccaacatgctgtatgtctgagggaccagccgtcttcacaggtgtgtctgcagccgcccagccccctgactacggcactcatggctcacaggcccctgggcatcccctcccccatcctacctcaggcccaaagcaggcaagcggaggtacgcccgggaccctcaggcccattttgcacctctgcctctcctaccctttcctggaagaaggggttcctgagtgtgtcaggaattgcagcccccacccccagcagccatggccctaattggctccaaactagtccttcccaacaggcattcttccttttcagatcaatcctctaaccctcgctgcccaactagggggctggagactgggtggggggtgcaggtgcctccctgagcagaaggcagctcccagcatccccgtctctcctgcctgctccctcagtgagggtgtccatagctgtctaccctgggttggggccttgaaccagcctccgactccagttccctggacaccaaaggcccacactgcaaagactctgcccctggctagcctctgcgtccctaggacacacttcgacgtccaggcccttgcaccctctggccttcagcacccagagacacaagtcactcacacccaagcctgtagctccccaaaatgctgtcgtcccagaatcacacctcaccagctgggccagagaacacggtgacccccaagcggtgacagggcacagtgccaggcccacgttgaattactcctcccagggagaagaccctgacccaggactcgaggataagcagctaaaaggcacccaaggggaggctctaagacaagcgcggcccccctgtctccaccggggagggcgctcgggtgcccgaggactcctcccccgtccaggtagaagggctgggagagcacgaggtaaagccgcttccccctgcccttcggaggctccctccagcacacccgcaggggtgaggttaggactctcgatcctgaaaaccctgaaaaccgcagggacaagctccgcaggggagagtaactcccagccccaaccgagccccgcatctcaccaccggggaggatattcggcagcccgggcagtcgcagatcggaggatgcacctgcaggatccccttggacataagcgtcttcagacttttccctgcgagcagagccgaggcagaccctgtgagggagcggcacgcttctgcgcgcagtcagcggcagggccagtaccccctccccggctcgtggacgaaatacaccccgaaccccacacccacctcggcccgacttcccagcccgcttcccgtcccaccctcgcgaacgccgcagggatctgctgggctctgcaactccagcccgggtggagcgccctcccccgacgaagggcctgggcgtccccacccggcgcccctcctcccgcgctccaccctctccccggccccgagggaaccgcacgccgggcccagaaaggctgagtcccggagcggtgagcggcgccgtcgggaccctcggcctgcgcggcaggaagaggcggccaccgcggaaccacgcaccgctcaggtcccgaactttttaactccccgcggcgcctggcgctcaccgcaccccctgtgtcccggctcatgcgcccccgcgtcgcacccttgggcccaagcgcccgcatgcgccaaaacacgttgtgtgacctggcgccgccgctcgggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12462 - DNA, 22372 bp, Homo sapiens
atccacccacctcagcctcccaaagttctgggattacaggagtgagccactgcatccagcccagatctttcttttacctgcccttggccctctcctctccctatctccccaggtgactcatctggtccatggttgaaaatactatcccgtatttgtatttctggttttgacctctagatttatatatgtaagtgcgtgacttggatgatttattattattattattattatactttaagttctagggtacatgtgcacaatgtgcaggtttgttacatatgtatacatgtgccatgttggtgtgctgcacctattaactcgtcatttacattaggtatatctcctaatgctatccctccctccttcccccaacccacaacaggccccggtgtgtgatgtcccccctcctgtgtccatagatgattctttaagtgtctcaaaattaacatgtccttttctccctacacctacccaccttcttgtaacaaacaaacctggtcttctccaaacctcccttctcccagtacctggcacaaccacccacccagtcactaaatccagaagcttagtcatccctgacacttccctttttcttaccactcatctaacccaggaccaagtcctataccaaatatatttggtatccacacacaactgtccatcttctttgctacccttctagtccagaccatcttcatcttcttcttggactatgcagtggactctcaacttctctctccatttctgttcttgcccgcttcaattcatccttcacacatgagcaacaatgaacttcttataaatcctattactcctctacttaaaattgtagaatgatttcctactgcactcaaaatcaaattcaaactcattcccttggcctgcaaaattctgcatgacctggatcctgtatatatttcctatatcatctcatgtcaatgtattccaagtctattatgctccagcctcaaataagcatatatccacattgttaactctctcttagaccctcatgtgctgccttcctaacaattcttatttcccattgttttccccagaacctggtgtaaggcctgggacacaaaatgtttgttcactgactggataatgaacagataaggcaatagatgtcactggaaaatgatctttccattccaagaaagtgctaaaagacatcatgaaacatcaaaagtttcaattgccaaattctgtgttatggcttacacagataatgtagtctgttaataccaaaaagttaacagaatggcccaaaagaatgcctcatttggttaagaatctcacatatgttgtaaaatatagacaaagtgaagtgtatactcagatatttatttactggaacttcattaataatgagcaaacaataattaagtaagcagcaacataaagctatgcttttaaaagagggctgggaaagagttcttggcaatagcttagggggccacatgatgataatgatcacaatcatggttaactatatgctacagacactgttctaaatgctttatttaaacctattcattcaatcctaacaagaagggtattgacttcattgtccaggaggaaactgagatagcaagaagtaaaaagtaactaatccaagagttgcatagtaatagagctagaatttgaaaaaaagcagtctagctttatagccctggcttttaacactacctgcctagtccttccaggtaatctataaagaacaaagttatcattaaaaaactcaaggacaagagaaaatactcccatgaactactgaaaagattaagtagttcaagaatacaaacaaactcttgagcaattataggtatattagctgtgatataattactcaatagattgcccttgcttaatttaaatatgccttaaactttaagtatcaccttttatctgacacagaaaattatctcctgttcaaatttccttgatgctgcaaatcaaggagcatattttaaaataagctttatataagggcctacataatacctaacttcagttcagcaaactccatccaaagctgctttcccatataaaataaggaatttcttgaggcaatatgctcttagcaatttactattcctcaaaatatttgcaaggctttgtgaaagcagagtaacaatttacaaaaccacgacaaagttatcacttcaatttgtcctgtttattaggattctctaatctagagttcatttccacaccaaaatgggagacacagcaagggcacttgggcaaaaacaggaatgacagtagcacctagaactatcatctccgagaaagactaaagagactaaaaagtttgttaaatcaatggaaccaaaaaaaaagagtacccaacaatgcaaagaattaactcttctacaatggctatttacccagaataaaataactagagaaatggctctatatataatagataattaacataacaaaatattaaaattacaaacagcttggggaggtttttttttttgtaagagcaaataatacagttctctcctactgcttttcttttattttcttctcttttttttttgagatggagtctcgctctgttgtccaggctggagtgcagtggcgcgatctcggctcactgcaacctccgcctcccgggttcaaacgattctcatgcctcagcctcctgagtagctgggattacaggcgtctgccaccacacccagctaatttttttgtattttttgtagacaccgggtttcaccatgttagacaggctagtctcaaactcctgatctcaggtgatcttcccgcctcggcctcccaaagtgctgggattacaggcgtgagccacggcgcctggccagttctctcctactctttagcaacaacattcacagtagacacgtgttaaggctcctccgtcatttccacttgccagaaagataactcaacacatgacagtcatgaagcatgaactcagacaaactattctgaagaatataactgattttctttccttaatctattacacttcaaatctagccaagcacagtttttgttatgctacaatttataagactaaactagctaaagagggaaaaaaagtttgtaaataaggcttatgtgcgtatgtgtgtatttacgtgtgtatgtggatagatccctttaatacctaagagtaattattttcatgtgaacttggaaatattaccaaaccataataagatgcctggatacaaccttgttagaacagaaagaacacttgagaccttacagttcaggttctagcactacctaagccagatgacctcaagcaagccaattactaattactgattgtttctgagccttaattttctcctctgttaaatgggaatctacttatacattcacagagattccttctaattctaaatattggtttcagtgaaataataatgtttcttttttttttgagacggagtctggctctgtctcccaggctggagtgcagtggcgcaatctcggctcactgcaagctccgcctcctgggttcgcgccattctcctgcctcagcctccggagtagctgggattacaggcgcctgccaccacgcccggctaattttttgtatttttagtagagacagggtttcactgtattagccaggattgtctcgatcgcctgacctcgtgatccgcccaactcggcctcccaaagtgctgggattacaagcgtgaaccaccgcgcccggcccaataataaggtttcttatttaatgtaagtaagataggactacttctactctttagttaactatacgtaggcaaaaaacttcagctttttctgcacttggaagttctgaagtgacaatacatgacgaccaaaaaggatcagatttaaactcccgaatgcaaaactatactcattttccaggaacctatttattaaccatggtgactaattcaatggatcacggtatcaaactattctttgctaactttcaaaggtggggcaaagatcatctcagaaaagtatgtgataatattttcagataatgatgcaaagtaacagtattctacactgacatatctccagttctaagagtaaagtgataccatattttcatatttaataatttcatgtttactagctcatttaatctttgtgacagttgtatgaaagaaagtgagcagaatttttatcaacacaatctagaccagctcagaatgttaggtaacctatcagccattacttaacaagtgttggagcccagacttcaatccaggtcttctgatttaaagtttaatagttaccaaaatcctaaaaagtggtgattcaagccaaaagcgagaagttggaaaagtgagaaaaactggataatcagtccttcaattgaacataaagaagataagatcagatttggcagttatataatcaagaagcaaatttaccgaatgttaaactaatgatacatctatcataattccatatctcaaattttgtcaccttgtttcaaagccaagcgtgaacaaattttcaaactcaaaataagaaaaatatgtaaactgacaaactgatttaactagctataggtaaactggtaaaaggcatcatggttctatgtatattttcttctggaatgtgactcatagaaattaaactgtattaatcaattgtaatcaagtaggatatatccctcaaaggaaaaaagtaaccttcagtgccttaagataatgtaggcaaagtagtaaaatataaaatttctactcgagagagtcacttcatacctacacaaatcagtcacatttgtctaggtaccaccatccctcttccacagtaaaaacataagctacaatgcatacaatgatgcctagtaagtaagtttcttcctttcatcatctatgctaagaatacacaactaaaatcagagctaatgacaatacaattactaggtagtagcaactggaatattaaattctatcatgacaacaccagaaacacttgtacaagcttcttcaaatgatcaatgtaatctgtccacaaaaatctctgacaagccccaaagtagaaatgaaagacgttaacattaggataaggagcgatgctgccaaaacacatcaacagtggccagtctacgtgtattattagatttttacatggagttgcaggtaaataaaagatgattgtgtaaaatcttctggaggtcataagtaatctagcagtgtgacacagggccacatatggtttctggaattttagagattaagtcgaccttcacgttttactgcaaatacctccactgtaataagatatagaggtcggggttcaggggtttggaaaggcagacaactctttttcattaaagcagtgaaaaatctgagaagttcctctccaagggctctgcggagcgaaggcccattcccttggctaccctgtaccaccagagctttagatggcacttgcacgcctggatttcgtttaggagcgaatacatctagcatcatgcgccagaggttcgggagagcaaaaaccaaactgacagatcctgagaaatagctcagtcatcagcagggaagaccttctccacttactccaaggtcctggacatcccgggactaagaggttctctaaagaagcctagcaaggcttccaagtacgcggagaggagaacgaacagcccggtgtctgggttcaatgtccgggtgaccaaccatgagaaggtgtcccaaataacctggctaccgccagcgtgagacatccagggtgagacatccagtcagcagcgtcctaaaacactgctggaagtcggaatcacagtgccccagatccgcaatgcctaagtgggagagctccggaagacgccaagctctgaggacagcctcaggcttcggtccccaattccctgagttagtttacctacccgctccgaccccggctgctccggatctcaggatcctggaagctgctccttacggactctcacacccgccgctgggctccagacaaccggaacccgctcacgtcacttccggtccggtccctctgccccctgagacagcctccagaagggatacgttcctccctcctttcggcgagctcggttgatcctcgcgggatttcagttaggctcttagtgcgggccctgtgggtgtggcaagaggaagaatgactgctcgctttgtgattcttgatccggaacttgtcacccaggaaccccggaagaggtagctcacgcgatagaaacgtgttcgctgcccagaagaagggaaggcgcgagtgaggaaaggaggtactgtaggtaggttggttggctccttacagggcgaaggagaccaatatcattattcattttctcgccagtaggaacgtttcttttcacctcgttgcattacccaccttcttcattttctcctttataaactgtcttccgcccaggggccgctgagccctctgttcctgttctgcgaaccgtcctttggaggaaaggaacaggctgctgggkaggggaagactcagaatttctagttcccagcaaagcctccakgcaggcagtatcgatgcgctctctccgaaattgataaaatagcgagcaggcctcataccctcagctgggcacttatgaatatccccagcgtttcgagctgtcgagctctgcgtggaaagaattggtttctaagaatatagtcgaaaatttggggccgggcgcggtggctgacgcctgtaatcccagcactttgggaggctgatgtgggcggatcacctgaggtcagaagttcgagaccatcctggccaacatggcgaaaacccatctatactaaaaatacaaaaattagccggcgtggtggcgcgtgcctgtaatcccagctactcgggaggctgaggcaggagaatgacttgaactcgggaggcggaggttgcagtgagccgatatcgctccattgctctccagcctgggcgacagagtgagacttcgtctcagaaaaaaaaaaaaagaaagaaaaaatttcccccctttttcacacaaagagattaactagagaggtattaatccttactgacataccccaggcaccatactagactctgggaatatgytatacagggaaagtggggcagtggcttaagggtcagagaagatttgggaaaggtttgtttgtttttttcggttgtaaactgcagacccggcgcggtggctcagcctgtaatccaacactttgggaggctgagacaggaggattgcttgagcccaggagtttgagaacagcctgggccacatagggggccacatagtgagaccctgtctcttaaaaaaagattaacgggtggagcatggtgcagaaggaggtaatgggatcaagagcactactgaaatgggtttactgaggcaggggaattagaaggcaccaagaagaagattttataggatgtacttattttgttctgctgtcattgcccagaattatttatgagacaaagaatggttatttgttttaccttagtcttaggcactaggcttattgatacgcttgtcgtaagtgtacagaaaaagagacagacatgttgttttagaggagttagatgataatctgatcagattaatatgagattagaacatcctaaagaacaaaaatatgtgttaattttagcatttttatgattagacactccattgagatatgggacataataaataaacttggtaacttttggaactttcactgtcctgtttttgatcttattgggtttttttttttttttggagacagggttttgcattgttgtccagcctggggtgcagtggcacgatcatggctcactgcaatttccacctcccagcctgaggtgtcctcctaccttatcccctgagtagctgggagtatgggcatgtggcaccacatctggctaattatttaaattttttgtaaagatgaggtctcactgggttgcccagattggttttgaactggactcgagatgctgctgcctcgacctcaagcaactccttgaggccaggagttccagaccagcctgggcaacatagcaagaccaagtccatacaaaaataaaaaatttttaaaaaatcaggagggtgtggtggcatgcrcctgtagtcccatctacttggaaggctgaggtaggagaattgcttaagcccaggagtttgaggctgtagcgagctatgatcatgccactgaactctagcctgggtgacagagggagaccccttctctttaaaaaaaaataaagaaaaaggcaacttctctgtttgatcctcatatttctcatctttaaaatgaggctaatatatcttcctttttatgtgttcatagcaacaataaatgaggtaatggatataaaggatttagtatgttatccagcacataatagcttctctatgtagagcagttccttctccagatagtaccggaatgtagtgtatgggatatttggttactttgcagcctagaaattatttcagagaatcctaattgctgacattgcatatttgttcagtttggagtctggttgttagattatcaaagaaaagtcctgctgatatgtaagcatcaaatagaaacttggccaggcatggtggcccatgcctgtatcccagcactttgggaggctgaggcaggcagatcacttgaggtcaggagttcgagaccagcctggccaacatggtgaaaccccgtctctactaaaaatacaaaaattagccaggtgtggtggcgggtgcctgtaatcccatgtacgtgggaggctgaggcgggagaattgcttgaacccggaggcagaggttgcagtgagctgagatggcgccactgcactccagcctgggtgacaaagtgagatgccgtcttaagaaaaaaaraagaattmtctgtctttgtctcttttagggggtgggggctgtaaaggcactagaaccataaatactatgtctgtgcagccctgtcaccgtatttaggcacttgagtggaagagcactgaaactaggtgcactacagcttaccctatgtgaccctcctactcctggccactccatgtcagtctcctttgattcctaatgttcatttcctcaggattatgttttagtcctttcttcattctacatatttgtccaagtggcctcatactcttccatctcttcagtaacttcaattatatggtaaggtctctcaaatctatatttccagcccagacctttctgactttaaactgatatatcctagacctttctgtcctttaagctgatatatccttttttttcttctttctagatatctctgagatgtcttttgttcagaacaaaactaattcattatcttttccattcaaacctggtatttcaccaaaattctccatttgttcaaatctagctgtcattattaacttctccctttcttttgccaccagacttcctgtcagtcactaaatcagacaggtgtaccttagacactttttttatttctcattcccactactgttgtctaaatgaccatcatctcatctagactgctgggagaggcctgatatagtaatgttaagaacaagggctcggcagggcatggtggctcacgcctgcaatcccagcactttgggaggtcgaggtgggtggatcacctgaggtcaggagctcgagactagcctggccaacatggtgaaaccccatctctactaaaaatacaaaaattagccgggtgtggtagcacatgcctgaagtcccacctacttgggaggctgaggcaggagaagcacttgaaccccagaggtggaggttgcagtgaaccaagattgcaccactgcactccagcctggcaatagagtgagactccgtctccaaaaaaaagaacaagggctcggcagggcatggtggctcacgcccgtaatcccagcactttgggaggccgaggtggctggatcacctgagatcaggagtttgagaccagcctggccaacctggtgaaaccccgtctctactaaaaatacaaacaattagctcggtgtagtggcgggtgtctgtaatcccagctatttgggaggctgaggcaggagaatcacttgaacccaggaggcagaggttgmagtgagccgagattgtgccattgcactccagcatgggagacaagaacaagactctgtctcaaaaagaaaaaagaacaagggctctggattaagacgaccacttatgagctgggtgaatttaggcaagctataacttgtgtacctcatttttctacatccgaaaaatggggatcataattatatatagatgcttctcaacttagggtggggttatatcctgataaacccatcataaattgaaagtaccataaattgagagccaggcacagtggctcatgcctgtaaatgtagctacatgggaggctgaggtgggagggatcatatgaggcccagagttcgagaccagcctgggcaacataatgaaacccctgtgtcttaaaaaaaaaagtttttttttaaattagcagtgtgtggtggtatgtgcttgtagtcccagctactggggaggttgaagtgggaggattgcttgagctcaggagttcgaggctgcagtgagctatgatcactccactgtattccagcctggacaaaagagtgaaaccctgtctcttagaaaaggaaatagaagttggaaataaatttaatacacctaacctaccaaacatggtagtttagcctagcctaccttaaaggtgctcagaacacttaatttattagcgtacaatagggcaaaatcatctaacataaggcctacaagtgttgaatatctcrtgtaattckttgaatactgtactgaaggtgaaaaacagaatgtttgtatgggtaaagtttctactgaatatgtgttgcttttgaaccattgtaaagccaaaaagcttaagcgaaactacagtaagtccatgaccagctctatttaccttgaagtgctgttaggcacattaaagaagacaattcctatagagtgtttagccagtgtgtagcagaacacttcataaatgttaactattactacattatagcagcctctgaaatgatctccctgtatctattgccaactgctagtcaaggctcaggtatcttttagaacaggcgtccctgtggcctgttaggaactgggccgcacagcaggaggtgagtggtgggcaactgagtgaagttttatctgtatttgcagccactccccatcgctaacattacctcctgagctccgtctaattagcgacagcattagattctcatgcgagtgtgaaccctgttatgaactgcccatgcgagggatctgtgttgtgtacttcttatgagaatctaatgtctgatgatctgtyactgcctcccatctcacccccgatgggactgtcaaacacctttttataacatttaccagtcttgcaattatttgtcttcactacttatctatgaacagctgacagtggcccatattcatcactatatcctcagcttaacagggtgtatggctggcacatagatagccagtaaacatttgttttattgaacttaacttctcttggtctgaatttcttcatttttgatatggcagtaatcctcacttctcagtggatcaaataacaatacatgtcaaagtattgtggaaattttgagctataaagacaaagttttggccgagcacagtggctcacacctgtaatcccagcactttgggaggccgaggtgggcggatcacgaggtcaggagattgagaccatcctggctaacacggtgaaaccctgtctctactaaaaatacaaaaaaaaaaaaaaaaaattagccgggtgtgatggtgggtgcctgtagggaggctgaggcaggagaatggcatgaacccgggaggcggagctggcagtgagctgagatcgcgccactgcatgctagcctgggcgacagagcgagactccatctcaaatagacaaacaaacaaacaaaaaaaccccaaagttttaaaacagcatgaaagaaattcaaaattaggattggaccatttcaaaaccattgctaaaatgtaagcttcattagagaaaggactttttctgctttgtgcactcctgtatcccttagattctagaacagggtcaatcagtatttgtggaagggaagcagtatatcataaaactaaaagaattgaaaaagtagaaagtagtcacacttctatttcagatacccattcctatagctatgttctttgtaattgttcgtctccaaaatcaaaaccctatgcatcgctctaagtctttccagtttactttcattacacctgttcttcaacagcatgtctagataaatagcatgcatcactttattgtccataaatcagtctttgataatacaggttgctttttatcaggtaggccaaaagagaaaaatgtaataacacaggttgcatggtctatcatgtcaaacattcttacccttatcctaaattcccttgtaccactgtgtcttggggcgtgctcctggcataatttaaacttggatacatccaactaccatttcagtaggaggggagagcaaaggatgagtgtggatggaggttagtttgtatgtctggaggaagtgattagtagttttagtcttttggcttctaagtactactggagaaaatcacaaatagtatgttgccattaaaaagtcatcattaatcttaaccakgctttcaatattcctctgcaatcctgccatattttgccacaccttttatttccgcctttctcttctctactccattttaacttctgtctgagctccttccctcagggggaatactttcctgccttcaaatccgtggacctacttgatttaaaactgaaattgggaaaggtgtcccttttcctttccaaaaccacatccctttataaagtckttctctatcttgagcatttacctgcctttcttctggcttcatcctattaacatttaaatatgcttatcctttcttcttaggagaaaaaaaaaattgctttcctctgtgtcgccttatatccattgctttttctttttgctctatctcttgaccccacctcaaacgaatttctgccccaccaaagacagtaaccccttttatgttaaaattagtggaaagaatgttaatataatgccctaactttaaagaagaacataaaggaaatttataagtacttccagggctgtcatctatgccgtgccaatcatgcagtgcacaattccaagggcaccactttacattacaaatacagtgcattacaaatatagtggccccatgtttataaatgcttagataatactccactagaaaaagaaactgatagttgcttgccacatagaagcactgtgaatccagcagcctcatttgtagactgatataagtgtcttattggtgactcaaatattatgaacagctttgccgaagtagcaagattttctaaaataataaaggatgacattcctttgttttatgatagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttaagggataagaagcaaatcagtgatgcagcgaaatcgtcagcatcagttaaatccactgtcatcacaaagaaaagggctggaccaattgatgatatggaaaaattacttkttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcaygtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggcagaggcatttgctgctatcagcagtggcctacacgttagaagaaatggacgtcaattacgagagattcgccacagttgacaggcgcagatacaggatgctcttgcttgctacagagaaatatrtagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattaatggtgagtacccatacaaccattgttttccacttacagtattcaataaattacaggagatattcaacactattatmaaagagcctcgtgttagatgatttttgtccaactgtaggctaatgtaagtgttctgagcacatttaaggtaggctaggctaagtcatgatattctgtaggtgtattaaatgcatttttggcttacagtattttcaattaattgggttaattgggatataaccccatggaaaattgaggagcacctgtacatagtaaaactatgcaaaaaatattttgtgttcttaagtaaaatgatgttgagttctcatctcagttattaagtttttcagctgcactcacgtccaatgggacaactcttcattttgtaaggtttttagcatccttgctcaggcttagtaaatttcagtagtgcacctcactccaggcccattaatgtgacagtgaggttcttctgagggtaactgatttgataccatctccactgagaaccactgcattgtgaaaacaccgattagcactgtattccaggaaagggttatttttggtttctttaaatcttaggcatcttggtaaaacggaacatctccacaagactaagggaagactgaggaatagagtttttgaactttatgcaacttcgtttacatcaagattcaaaatgacctaaactgtttcatgtggatgcttgaatcttttctagtacactggtggtgggcaagagggtgttggaaacagggtgcaggcataagatcaraggtgtgttttgccttttttctggatgaccattaagtgtatagtcaaaatgtttctctgataagcctatacctctgtaagttgttactgccggatagtgataactgtttkcctttcctttaagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatkaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttctatggttggcagttgtcatcttgggcttaaaaacagtactgttggttaaatggtcttggtggttcaagtgagaggctgaaacagatatttaagatgagagaaacaggtcatgatacaattggattaaaatggaggaaacagcatttccctatacatggttaggtccctttgtgttggtagcccttccccaagactatgctgctgtccccctggaggtcgaggttcaagggtattcccactagaggcaagctgcagtttgttcccctgctgtcactttttgggtgactgatacagccaccctcaatggagtcccatggtttataacctgtttaaattttgtctccaggttgagttttatagcattgatacaacctactgtgcagtgtttcatgttcaccttccctgacccatactggccaaaggttaatcagcagtggttctaaatcacagcctattaaagtttctcacttcccccctttcttgtaacaatgaagccactgaaacttgagtaaccttatggaccttaacagatggaaatgggtgggcccaagtaagaatttatggtaactgtaaagtgaacgtagtttgtcatccctgctagtattttttcctagaactaactttgacaattaagggtgccttttttcccttttgatctttagatacacttgatacaatcctaataattactatgttataccagttacccagaatatgaggcagagggtcccaactccccaagccacatagcttcctgatagtcatcttgttagaaactatttaagccttcttttaggaggatactgacagtaatttctaaaatcagtgtatccccaagaactgtaatgatgccagggagaattttggtaataggcccattttaagtggctccacctctctatggttaactgcaatataagcagcgttatagcaccatctcaaggtctaaggtcattggtggagtattgtgggcagaacactaaagacagccttgaaatttctaatatttgattcatttaatacacttcgcacaggcatatgacagcacaggagaaaaattgcaactgtgaatgatgccacaatagcaactatttctaaacagaatgtttactggctgcaaaagtgatgcaacaaaatgcaacgttaagactgagttgaactcagtgctaagtgcatgattctggctcaggtaatttctgaggtttgcctcagatagactgatggctccaaattcaaaggtagtggcattcccaacaggatggcatggggtggctaagtaactgtcatggcatatctactaaaaggaatactatgaaaattctggtaattgtggatatatgcttgttttctagttcatctgtacttggtattttatagaactcataatcttatagttttcaaagtatactctgcagaacccacagggtctccacagagtcaatgttttcataatactattatttttttttttctctgtgttgatatttgcactgagggtgcaaaagcagtggtggggaaaactgatggcacctcccacaaatcaaagcaggggcaccattgtattcttcactgacctgcactcacattaaacactttcacttaatgtcctggatgaaactaaataggtttttttgttttttgagacaagagtctcattctgtcacccaggatggagtgcagtgacgtgatcttggctcactacaacctttgcctcacaggttcaagtgattctcatgcctcagcctcctgcctcctgagtagcagctaggatcttataggcatccaccatcacacctggctgattttttatttttagtagagatggagtcaccatgttggtcaggcttgtctcgaactcctggcctcaagcaatccgcctgcctcagcctcccaaagtgctgggattacaggcatgagccaccacacctggtgggacagggattttaagttttaaaaaactcttctgtggagcttatgttaggtaatttgcctaagagagttgtaaagcagtgcaagactaactaggcaagggggtatgtgtagctattgaggattaagggatagtgaaatgaactttaggaacattctcagccataagcaagagctggattcacacaaccaatttttgaaaaaaatcaagatacccataatttgggcacctttataattcatgatgagaaagagcatgttaactacatgtttaaatatattttatttcaagttaatataacagccatgatttgttcatttaagtgaaatgcttcgataaaaacctcggtgtcacttggttaaaatattggagacagattaaatgttaagccactatagtagtgactctggttctttagactattgcatgtaccttgttaatgaactacaggaatgcacattgatataatgcacaatgtcttcacatgtctcaatcctcattcctcttcctttcatgcctccctaatgcctcagtatccaatataaaactacaaaaactactgttcttttcgtttgagtggtatttaattaaaacttcaattctatgttatttccacagtccagtaatttattttaaatttgagtaatttcaaattccacaaacaaaactgaagaacagcaatattttgtttgaatttctctcttctgtacactcagtgatctaaaacaccacaatatccaacatacacaaacctcagggaagggttagtaaacacacacaagattggaatcatggtgctctttgctcctgaatggaatggtcccacagaaaaagcacaggatacagcacaacataagggcacctgttacatatgaagtgagcaaaacatactagcattttctatatgcataatggggaaacctgcataggttagagggccttttacgctcatttaaaaatcaggcaagttgtctgtaacatttttcaataatctgggaagcactgcaatccagtgtacgatgtgctgattagtgttgtctttgttggcactgacagtcttgcatggtcatatgccagtgtttttgctttagcttttctttgaataaaacagatttaaatgcatttagacaatacgtatttgtaagctgtttacatacactaaatttaagagattcaatattagagtttctttgtttctttaaacactacagagtgcaaatcaggttcttcacaacagattgaatattgagcagttctttaaagaaagagggggaagaaaaaaagcccaagtgaataaaacattgaaactattccccttcgaaaataaattctaaaatgatgtggaatgtgaaataaggttttaacataggtgatccaagtttatagttagaaacaaaaagaagtccttcatgaaataaaggttacaagaacacgttgcctgttttcccccattataaactgagaagtgggtaaagacgatgtttcagtacgaaaataggtgactacaggatcagcgcttcatctcacatgctgtacccaaagccaggctgtggctgtccatacggtggtgcggtataaccataaccaaaaggtgcctggggagggacggcaacactgggtcctgctgtcagcatcaactggggctgacctacagtagaagaaaacaaaaaggagcagggggcaggggcaaggaggcaggacaaactgttagcatttagaacactccaatctcctccactctagcaacataatctcaacctcaaatgagttgtatggggggcacatttgattgctacaattttagcatgacagtcttactctaagaaggttcctacctaaaaagccaacaaacagtgcagggccaaaggccagaactgcttatgactgaacaccgtatgcctgacactctgtatacttgacacatacctacatgcatattacacttcatgacacaataaaatcagcacaataaaagaattttttaaaagactttttaaaaaaaaaaaaaaaaaaaagaatctggctctgttgcctaggctggagtgcagttgtgtaatctcggctcactgaaacctctgcctcctgggttcaagtgattctcgtgcctcagcctcccgagtagctgggattatgggtgtgcgccaccatgtccagctaatttttgtatttttagtagagacagggttttgccacgttggccaggctggtattgaactcctggccacaagtgatcagcccatcttgccctcccaaagtgctgggattataggtgtgagccaccatgcttggtctaaatgacatgtttttaacataacttttagagttacatttaaatttctgatttaaacatgtctaaatggcaatgaaaccaaattcatttatagaagatccagtactaatttagagacagcagttaaattaaaaataagacacatttgggccgggcgcggtggctcacgcctgtaatcccagcaccgtgggaggccgaggagggtggatcattaggtcaggagttggacaccagcgtggccgatatggtgaaaccccgtctctactaaaaatacaaaaaaaattagccgggcgtggtggtgcatgcttataatcccagctactcagcaggttgaggcaggagaatcacttgaacccaggaggcaaaggttgcagtgagccgagatcacgccactgcactccagcctgggtgacagacgagaccccatcttgggggaaaaaaaaagacatattcagacattctttaggtatgaaatacattagaacatacaccctctatcaaatactatgttgacactctttcttataaagtttaaatagttgttggccatatacagaaaacatgacctgtagagaacttggcttagagagcgaaaacaagtaacacctctctctacccctacaaaagtatttttaacatcccactacagtgtaaacctagatcaagatttctcctacacaaaggacttcatgtctttgctttttgtggttaacaaccaaagctgtcttcagcaaacaaattattattggaaaccagtttattattattttttgagacggagtctcgctctgtcgcccagggaatgcagtggtgcaattttggctcactgcagcctttgcctcccaggttcaagcaattctcctgcctcagcctcccaagtagctgggactacagttgcatgccaccatgcccagccaatttttgtacttttagtagagatggggtttcaccatgttggccaggatggtcttgatctcctgacctcatgatccgcccaccttggcctcccaaagtgctgggattacaggcgtgagccactgcacccagccaacagaaaccagtttttaaaaagtcatccctaatcttgataatgacatctacttgaaattccaacccaattttcaactacccatgaaaacaccctgaaggcaagccaaattcagtaggtaaccccaaagtattacacccatcttttttttgttcctactgtgtttcctatgtctttttcacctttaaggacttgatgtgtttcctatctcaaacatgtcaaacatcttgctcccatctctaagaacccactttatcaaaactatcctgtcctctaaattcctaaagtactttttatctacagtaaaaaggagacaaaaccataataagtgtatatattattatttgtgtcagtagcctgatatataatggttatatatatatatatgtatatatatatatatattttttttttaaggcggagtcttgctctgtcacccaggctggactgcagtggcacgacctcggctcactgcaacctctgcctcccgggttcaagcgattctcctgcctcagcctcccaagtagctgggactacaggcatgtgccaccacgcccggctaatcttttgcatttttagtagacacggcgattcactgtgttagccaggatggtctcaagctcctgaccttgtgatccgcccgcctcagccttccaaagtgctgggattacaggcatgagccaccgcacccagccataatggtcatatttttatgttccctcacctggttattgtgcttctacctatactcttcaaagtgattgttcaaatgaatctgttcaccaa

SEQ ID NO: 12463 - DNA, 13900 bp, Homo sapiens
  misc_feature (1)...(13900): n = A,T,C or G, or insertion/deletion polymorphism (see Tables 1-2)
tggtgatgaacaatgactagcagcagacttcttgagaccttattatgtgctgtaaatttggctaggtactttcagatcttcactcaatccccccagacacctttctaaaaagtgagactcataaagtagtgggaatgctgtccgaatgggatgtgtacctgagtcttctgacacaaaatatttcaaagaaattggataattgaccttaaaaaaagaagttatacagtatcctagagtgctttttgtctgttggacttaggcccagagaggtgagttctctctacttgtttatagattaacaatgtggtatagtagacagaacagggagggctttaggggttgttgaaacaaatgctgtccaatagaaaaataatatgagccacatactttttttttttttttttgttttttgagacagagtctcactctgtcctctgtcacctagactagtgtgcagtggtgcgatctcggctcacagcaacctccacctgccaggttcaagtgattctcctgcctcagcctcccaagtagctgggattttaggtgtctgccaccatgcctggctaatttttccatttttagtagagatggggttttaccatgttggccaggctggtcttcaactcctgacttcaaatgatctgcccacctcgacctcccaaagtgctgggattataggcatgagctgctgctcctggcctcatataaataattttttaagttttctagcagccatattaaaagtgaaaaaacataaaattaattaattttgggtttttttggtagagacagagtcttgctatattgctcaggctggtctcaaattattgggctcaagtgatctgctcgccttggcctcccaaagtgctgggattacaggcgtgagtcaccatgccatgcccagataaaattaaatttaatatattttatttaacttgggatatgcaaaatattatttcaatatgtaatcagtataaaatttactaatgagataccttacattctttttcatactaaattttctaaatctagtgtgtgtggtttttttttctttttttttgagacaaagtctcactctgtcgccaggctggagtgcaatggtggatctcggctcattgcaacctccgccttccaggttcaagtgattcttctgcctctgcctcccgagtcgctgggactacaggcgcgtgctaccacgcccagctattttttttttatttttattttttggtatttttagtaaagatggggtttcaccatgttggtcaggatggtctcaatctcttgacctcgtgaaatgcctgcctcggcctcccaaagtgttaggattacaggtgtgagccaccgtgcccggctatgtatattttgtacttagagcatatatcaattcagaccctattttctttggaaatcctggtccgtatttagagttcataaaatttacagttagaaaggcagatttggggctgggggtagtggctcatgcctgtaaactcagcactttgtgagccaaggtaggagcattgtttgagcccaggaattcaagaccagcctgggtaacagagttaagacctcgtctctatattaaacaaacaaaaatgaagaaaaaggaaagcagatatgcaatacttcagtgatcccaaacatacttaagttttccagtaattgaatcacttactggttattatttaattttaattactttaaaattacggtaaccacatttcaagtgctcattatggtatgtaggttgtgacttgtggttaccatattggacaacacaggttaagtctaacctcttgcttttttttctctgggaaatgggcatacttatctcacaaagttattatgaggatctgagatcatgtatgtgaaagtactttacgtagcattttaggagcattaattattggctaaataatttttgtccagtacattttattcaggtatctcaaccaatgacacaatattcatttacagatccagtgttttatggtgtataagtatttggggttaacacatttacctaagatttgagtacttactgcagatgaggaactgtgttagactctagggacaaggtggtaaacaagatggactacaccttgcattcatgcttccattgatgagttggcaaaggctgtacacttgttattccaaccattgatgttgtctacttgattgtggatcttttatgtgttcgaacatttgatattgtgcacagtttaatacaaatattgatatgatacaaagttgattacactctgaaactgccccccaaaaagaaacttttaaataaatcttttattatgttccacgagtctcattgtgtgccactggtacattttaaattagggttccttgaacagacatatttgaaaaaaaaacttaatgaatcatatcggataaaatacccatatggaatgccggtcaggcgattgttagagttattgtatgtgttgtatgtgtccttttttagggtggtagtgttgaagtgaatcttctcacttagatgagcagtaggttcatggctgatattttagtcctgtatattagaatgaggctgtttctctaagttcatgcactatatgccatgccaaaactacttcatgaaataaacctgtcttctgagccacagcaaagtttacagctctgggtgtcttgtctttgcttcttggttaagtgcctatggctaatgctcttaactcaaaagatggctgaaagcttggacctaaatgtgttatgcaaaacccatctgtcagacttttgtgagtctcttcttttgtattatctccttaaattaagacataatttaagatatttttgtcctactttttttggggggtggggacagggtctcactctgttgcccaggctggagtgcagtggcatgatcaaggctcactgcagccttgacctccctgggcttaggtaatcctcccacctctgctccctaaatagctgggactacaggcgtgcgccaccaaacccggctaatttttgtattttttttgtagagtcggggttttgccatgtttcccaggatggtctcaaaatcccgggctcaagcagtccacctgccacagcctcccaaagtgctgaaattacaagtgtgagacaccaagccttgtcctatttttgaggcagtaactattcaaatcttaattgtcctgtaatctaatccataaaatcaaaatacatgggccattatagttgtttgagcacctattacgtgccaagaactgtattaaatatttaatgtttattatctcatttaattagcaagagaacccttgtgcttaggtcagattagccttattgtagagattgggcaactgaagttcatagtaggtaacttttagagtcacacagctagtgagcagttagacttttaatatttattctttcatttggctcattgcctcatttggtaaatggtctgtatcatttgaattgcaaaatgtaccacaattgtttatatctatgctgtgatgttctttgattctagtagtactgtcgtttgtttatcgtgaaatattttttatattatgagaaaagtaggagacagcaaactaacatctgactttatgccttgaatgattatttagctgtatcttttttaaggactttatcctgtttcctattggaaaattgtgcaggatgattgggatccggttaacttgtaaccaggattgtctgcatccctctcataagactgaacttgtcacacttttctatagactttttcttactgaaaagaatgagtgtgttccagtctgaagccacttgtgaaaggaggaaacttctgctttctattttactgtaaattcatgtttttgtgtttatgccaagaaatagaagcttgaactcaacgaaggcagttgtgcatgaaagggataggaaatgaaggtgacaatggaatatatttgctcattttgagtagcatcatggtagaaaggaaaatggttacagacttgtagggttgtgctttggaggcagactgccagtactgttaatacttcttgttcctaatccttaggtaaataaggattttcttcaagttctgaagtaagacggttttaaagattattgctgaaagaataggaaccagatccattaaagccatattttgtcacattaaaaaactctgcagtgtgctattctggaaaatgtctcagatgtttaatctgggcttatctattgattatgtcaggttttcaacttgtctcaacttcctcatttattaaaacaatatttcctggcaattttaaagttagactacagtatgtttttgtatttgtagtataatatttagccccttaaccccttacaggcactcgaatattagttcttcccctccaccctggaagagtttccctttgtccacttgagttgaatatatgtgccgtactaaaggagaaaaactaccatctacccagttattgaagccaagatcttgaagttacaccagactctctaatttctcattttctgcatccgtcgatttctggagttcctcagtgatgcacactgggggtctcagggatgacagtttttcatgaccctaggttgaaactgggagtcatagaagacgaaaaaacgagaattggattgggagttgactctgttgcccaggctggagtacggtggtgcaatcttggttcactgcaacttccgcctcccaggttcaagcaattctcctgcctcagcctcctgagtagctgggactacaggggcccgccaccaggcctggcgaattttttttgtatttttagtagagatggggtttcaccatgttggccaggctggtctcaaactcctgacctcaaataatctaccctcctcagcttcccaaagtgctgggattacaggcgtgagccatcgtgcctggccaacttgcatttatttctgattagctgctcatctgagaaaggtggcttaaaaaaaaccaccaaagtggacagactgaagctaaagactgtcagtatatatgctctgcttggcaaacagctgactttggatagatctcattatttaaagatgaataataagggggaaaaacgtgtagagagaacatggtttacaaaaacccatctctttctccagtctctgcaatattctatatttggtcatattgaactatgaaaatctaaggcaggtttctttattttaccacagatatcctcaggaaagagtctccttattaaaagccttactgaatctccatagtattgtgtcctctcacagttgcttctgttctgagcaccagaatgctgtttggcaaaggctgctgtaggcttgaaatcaactggattagtgagagacaaattttacacatctaaaattctcctgtgtatggcctcacagttggaactgttggatgttataagcagatgatttaaatatcccgtgaaaagcagtccattcgggcatgtttctagagatcataattttttttttttttttttttgagatggagtcttgctctgtcgcccaggctggagtacagtggcatgatcttggctcactgcaacttctgcctcccgggttcaagcggttcttctgcctaagcctcccaagtagctgggattacaggtgcccgccaccatgcctggctgatttttgtaattttagtacagatgggatttcaccatgttgtccaggttggtgttgaactcctgaccttgtgatccgcctgctttggcctcccaaagtgctgggattacaggcatgagccaccacacccagcctagagatcataatttacatagaaagataagagaaaaacaactctcctgataacgcaaatagatttgatgttacaaaactgcaccattatgattgctctgtaatggatttttgaaaagcattgtgaaatggagatgactttccagtgctgatgtcaaaaatgcatatgcagagtttaaatataattttgtgtgttttgttttttgagacagggtcttgctctgtctcaagtggagtacagtggcgagatcatggcttaccacagcctcaacttctcaggctccagccatcctctcacctcagcctcccaagtagctaggactacaggcgtgtgccaccacacccagccaatttttgtatttttttgtagaaatgggctttggccatgttgcccaggctggcctcgaactcctgagcccaagcaatctgcctgcctcggcctcccaaagtgctgggattacaggcaggagccactgtgcctggcctaattttataattttaaatgtctgtaaagtaagcaaaatgactagttgaattgtacattaaatatatctaatccctaagagtttataatgraaagggatcaaaactttttcaattgcgataaaactcacataacaaaattaaccattttaaagtgaacaatttagtggtatttagtgcattcacagtgtcgtgcagccaacacctgtatctagttccaagacattttcatctccccaaaaggagaccccatacacgtgaagcagtccctctcccatccccctcctcccatccgctagcaactgctaatttgctttttgtctctatggatttacctgttctggatatttcacataaatggaattatacaataaaggaccgtttgtttctaacttctttcactaagcatccatgttatagcatatatcagacttcattcctttatgactgaataatactttgctgaatggatatatcagtgttttatttgtcctttcatcagttggtggacatttgggttctttctaccttttggctattgtgactagtggtgttgcaaacattcatgtacaagtttttgtttgaatgcctgttgtcagttcttctagatatatacttagaagtggaattgctgggtcatatggtaatttctctgtttcaactttttgagagaccacgaaaccgttttccacagtggtggcaccatttgacatgcccactagaaatatatgagagttccattttcttcacatcttctgacagctttttggggtgttgggatgattcgtctaattgggaaaataagtaccttatttgggcctatatggtatttttaattctgtgtgtctgctcccaaactctgtagccctgccctcccttatattgtgtatcctgtttcagattgtttccgtttcttctgagacactgcatatacccctacatgtatctgtgctaggcatacatccctgtaacttcatggcatttttgtaattgctgtgtacctgttacgtatactgagtgggagtgtctcatttgctgtagaactctctgcattagtgtagtgtctggcacacagtagctgctcaggcattttttaagtatatgattattgggaaaactacagagctagggagagatctgaagaaatactagaaatttttttctgcaaagaaaactttagaaaattgttgacatcatctgtggcatgcagcaaaagttgatgtaaaaggaacagaaagacctatggagataatgggatgtaataacagaaaacatacakaaacaattggttctgaaatcagttaagagcagaactggaattcatactctgtggaatgaatcagcaatgtggaaggagtaacaagattttttaaaaagattttgaatttaggctgggtgcagtggctcacgcctgtaaccccatcactttgggaggccagaataggtggattgcttcaacccaggcattcgagactagcctggacagcatggcaaaaccctatctctacaaaaaataaaaaattagccaggtgtggtggcatgcgcctgtagtcccatctacttgggaggctgaggtggatggatcacctgagcctgggaagtggaggttgcagtaggctgaagtcatgccactgcactcaaacctggcggacagagtgagaccctatctcaaaaaaaaaaaaaaaagattttagtttagaagtaaatcccagaattaagtaaaagtggtgtgtgtgtgtttgtgtgtgtgacagaataggttacaaatttaagaattttagaaaccgggctgggtgtggtggctcacgcctgtaatcccagcactttgggagggtgaggcgggcggatcacgaggtcaggagatcgagaccatcctggctaacacggtgaaaccccgtctctactaaaaatacaaaaaattagctgggcgcggtggcgggtgcctgtagtcccagctactcgggaggctgaggcagcagaatggcgtgaacccaggaggcggagcttgcagtgagccaagatagctccactgcactccagcctgggcgaaagagcaagaatccatctcaaaaaaaaaaaaaaaagatttttagaaaccaaaataattggaatggaagctcttttcaatgaaagaaaacttttgtaatttgaaagaaccaaaattaaaagggcttagtgtttggaacaggcctgaagaagttgtaataccatgaatttaaaaaaacaaaacaaactcgggaggccaaggcacaagaattgcttgaacccaggagccggaggttgcagtgagccgagattgcgccactgcatgccagcctatgcgacagagcgagactctgtctcaaaaacaaacaaaaaaatccctaaaactataagcatctagggcacatcctcttcctgaccaaaaaaatcaaagtaatactagttttttaaccctgaattttagatagtgaagcagtgtctatagtttttgagatggaaagtgtcttcacttgtttttagaagacatgaatcacaatttgaacccccaaagagcctctgagagcctaaaacctgttttttctcctataggttgtttcctcactagtaatgacaaagttataatcttagcacaaaataagcaaaggggacagtttcacacaaaaattgtacttaaaatattgagtttgtgttaagttgctaaataatggatgctcaatatgtattaattgaaagcaaatcatggtggttgtcattttaatcattttaatgtcattttaatcattttaatgtcattttgaactccctgaatttgttaatattaaatcattttgagataatctgtaactcctcatgctgattgttagttaattcattcactcatttgaaaacagtatttgtggcatttaagctcacaggaaaacactccaggctgggtgcagtggctcactcctgtaatcccaatactttgggaggccaaggtgggtggatcacttgagatcaggagtttgagaccagcctggccaacatggtgaaaccccgtctctactgaaaaaatacaaaaattagctgggcgtggtggtgcatgcctgtagtcccagctactcaggaggttgaggcaggagaatggcttgaacccgggaggcagaggttgtggtgagctgagatcatgccattgcactccagcctgggcgacagagcgagactccatctcaaaaaaagaaaaaaaaatactctagtgactcaattgtaaaataaaatggttctagtcttataacttgtagcacctggtagactgagtatgccttaaatgattgatctaactagaataatgtgggatagagcataatgtctaatttcctggcaggtccctcagtatagggtagaaagataacatgaatatgtacaatagtgatggggttgacagaatgtaacactaggctcccacttaaatgtacattttgtgaagtcgctgggaagttgtgtcatagaatgaagtttatcaaggatctttataacttgaatattaaggagactgtccagatgttttattcatatcaggaaaccaagcctttaatgtctccctggttacattcatttataacatcctttatgctaagtcagcaataagtattatatatattttttgagatggggtcttgctctgtcacccaggctgaagtgcaggggtgcagtcacagcttgttgcagcctctgcctcctggactcaaacaatcttcccacctcagcctgccaactagctagaactacaggtgcacaccaccacgcctggacagtttttttattttttgtagggacagggtctcgccatgttgcccaggctggtcttgaacacctgggctcgagaggtcctcccaccttggcctgcaaaagtgctgggattacaggcatgagccactatgcctggccttgaaccctcaaagtaagcccatttggtaggtttggatatattctgcacaacttctcacccctgccattgaatgtagctgtggttgttttgtgctgctgaattgcatttatacggggggcataatcttggtaagtcatatccatctccaagatttggggcataaaaactcctgtatttccctgcagcttggttaacattggcctaattgatctgatatcatctaattattggcttattttttaagaatgcattaaatataaagtttttgaaaatttccaatcagcagttgattacaagtaggaaaaattctttgagtctcctggtagtttaccaaagctaataatagtctgacaacctctctccaactgtggttgcttcctgaatatattgcttaaatttggagtttgtgaccagaatcaaaaattctaagagccagtgattctctcaaaggctaacatggagtagaaaaaaactatatgtttaaatgtggggacagcaagggttaaaggcatttttatttgttgcttgaaatctgtggagcctacagaaaacagtggttggtatcctgttgatggaagaactaaaggaatgctgcattctcagcatttcttatttcctgtagaatacagcaactgcagtttttatttgacattctgctagtttccaggaagggctcaatgaagtgactgctgtcagcatcttttttcaccgcgactgatactagagaaggtagaggatgtttaggagcttttaaaggaaattatgtttagtgaaatacttgggttaggaagttaaccaaatctttaagtactgacttaaaaatgcttgtattgagagatgaatggtatcagaatgacatacaagtatcagcaggtctctcagattgttgacctattaactctacagtggtaacacttctaaagtccttggtaagatacaagattcatttgcagaaaatagctccatctgaaaaacagtagctcatacatacttcctttacattttccctattcagatgaaacaaggaggatctggaaaatgtgaagccaagcaataattgtgaaacataagtccttagtaatgctgtcataaaccagttttcatgtagtttgattttcagctgataaagctggtaaatgagttatactacaaatctatgattcattaggaagcaaactccttaggtatacttacagagaagccaatttccaatgagtttattcttaactaatcagatgtgagaactgctggttgaaattagtaggctcaaagcaaacctattactcctttaattatgtggcgtctgtaggcacaaacagatagattatgaatgattgctgagagtgtgccttggtgctaatggagagttgtctttagatagtttaagaattgggccttgaaaaaattatggttttatttggttgtatgtcttaagctagcattttctgcccttcttaaggtatatagtattgaattaaatatattaataggaccatggcctctttggtcctcttaacaatattttcatagtttgatcactaatatattctgttaagatgctcatacaacaccattaagtttcctgattccttgatgtatcagggtttccccattctgtctttaggagcatgtgaacaaagcgaattggcccaggtaaggtttgagtatataacagtagcatgatgctaaaaccagtctgtttaagaacagtctatatcggccaggcgtggtggctcatgcctgtaatcccagcactttgggaggccgaggcaggcagacacctgaggtcgggagttcgagaccagcctgagctactccggaggctgaggcaggagaatggcttgaacccgggaggtggaggttgctgtgagccgagatcgtgccattgcactccagcctgggcaacaagagcgaaactacgtctcaaaaaaaaaaaaaacagtctatatcataataccatagtcccagaactagaagttcatcaaataatggagtgctctgtgctcccacactaagtgcttgatgtgtgttaaatcaccttaacctttcatggagcacctaggcatgctgctttgctccctctcaagtaaggatggatactttttttccctttccattttccatatttacaatcaaatggagtatatttttaaaaccaagacaggaaaaacaaagtttaaaccattaaaaactgatgagcattcaacgtagatttctgagtctcattgctgatgtgttttttatttttattttttatttttttggagacagagtcttgctctgacgcccaggctggagtgcggtggcgcgatctcagctcactgcaacctctgcttcccttgttgcccaggctggtcttgaaccgaactcctggcctcaagctatcctcccatctcaacctccaaagcactgggattacaggtgtgaaccaccatacccagtcttgtatttgcttgtatttgtttcttttgcttaaacattttaaataaagtcaggctatcatattttacctgtaaacacttcagcttgcatctttagaaaataaggacattttctttctttttctttttgagatggagtttcactcttgttgcccaggctggagtgcaatggcacgatcttggctcactgcagcctctgcctcccgggttcaagcgattctcctgcctcagtctcccgagtagctgggattacaggtgcccaccaccatgcccggctaattctttttttttttttttttttttgtatttttagtagagacggggttttgccatgttggccaggctggtcttgaactcttgacctcaggtaatccacccaccttagcctcccaaagtgctggaattacaggaatgagccaccgtacctggccaggacattttcttataatcataatattatttatagctccctgatatttaagaacaatatcagaaaaccagtccatattcatattttcctcattgtccctaaatgttgtttggtttaaatcagaatccaagaaagctcatactgctttcagttatgtctctgaagtttcttttcttttttttgagacggagtcttgctctgtcgcccaggctggagtgcaagtggcacaatctcggctcactgcaagctccgcctcctgggttcacgccattctcctgcctcagcctcccgagtagctgggactacaggcgcccgtcaccacacctggctaattttttgtatttttagtagagacggggtttcactgtgttagccaggatagtctcaatctcctgacctcatgatccgcccgcctcggnnnnnnnnnnnnnnnnnnnncaccgtgcccagcctgaagttttttaaaaaaaaaaaaaaaattttttttttagccgggtacagtgactcatgcctgtaatcccagcactttgggaggctgaggtgggaggatcccttaagcccaggagttggagaccagactgggaaacaaagtgctgcctatctctacaaaaaaaaaaaaaaaaaattagctgggcatggtggcgtatgggtggtaccatctatttggaaggctaatctattatcagtagttaaaagaaattcacacccagagtttcagccaacctatggacagctgaattaagcagcccaggaggttgaagctgcagtgacccatgattgtgccactgaattccaccctgggccacagagcaagaccctgtatgagaaaaaaaagaattggaagtcctaaagtgtaatttccttttctcctcacttccccaacaaaaa

SEQ ID NO: 12464 - DNA, 87460 bp, Homo sapiens
  misc_feature (1)...(87460): n = A,T,C or G, or insertion/deletion polymorphism (see Tables 1-2)
attcttaataattttgaactgcattttcatttgcactgggccctgcaaattacacagccagttctgtctacagatgatgcacatactaattatatatataataacatatatgtaagatatatattatatataatatgtacattatatgtataatctgtgtcattaaaattctttgtaaatgttatttttttcttttttttgttcagtctccatagagactgtcaaaaattgcgaatgccaactatatttcaagtcattatggcggggtattgggaaaagttttcaattagcagtaatagcacctcggataaacctcattggctacgatactgccactgcacaaagctgtaaatgttatttttaacacatactatttcatcatatggaaacataatcatttatttaactatgtccctattttgttttaaattttaaattttttaaattttgttttaaattgtgtactgttataaataatgataagaaacatctttttacgttaattaaaaatagatttctgactatttccttaaaataacatcccagacataaaactgaagggataaaaggatatgaacattgttggacctttgtatttaaattgccagatagcattccagaaatattaatattatcagcagaaagtaagaaattctcttttcttactcttggtggcaaagaatattataattttaaaatatttggtaaatgagtaagtcaaaatattatccaattactttaatttccatttatttgactaccagtaaagaaggttttaaaatatacattttattagtcatttttatttcttcttgaaattgtccttagactctaaactcctcaacatgatttttaaggcacttggtgtcctaccactccgggtttatcttctaccactcctctccttcccattccccaccctattctaagctctagccatacttaattttatttaatatctacaatttgtcatgctttctcttgcttctggcactgtaaacattctacatactatttctggatgtctttttcaatatctcttgtctggttaatttctatttgtccttcaggtctcagcttaaacatcacttccccagaaagcctcccccacccccagattaggctgagtgccctgctaggagctcccaaatcatcctgtatttttcttcttcttcttcttcctcttcttcttcttcttcttcttcttcttctttcttctttcttctttcttcttccttcttccttcttcctcttcctcttcttcttccttcttccttcttcttcttcttcctcttcttcttccccttcttcccctttttcttccccttctcctccttctcctccttctcctcctcctccttcttcttcttccctttcttcttccttcctttctttttctttttcctcctcttccttcttctttctccttattcttgttcttcttctgtcttcttccccttctccttcttctagtacatatttaattttgaaatgattttagatttaaagaagagctacaaagatggtacacagagttcccatgtacccttcatccagcttccccagtgttaacatgttacataaccatggtaccatgatcaaaactaagttatgaacacagttatgatactattaactacagactttattcagatttcactaatttttttcattaatgtcccttttctgttctaggatctaatcctggatagcatattgcatttagttatcctgtctccttagtctcctgtacttcatatcttatagtgcttaatgtattttattacaatttcctcccattctagaatataagctctgtgagagtaagggctgttttttaaatttttcatttatttttatttttaaccattgcaacctcagttcttacagtcgtacagtgtccatagtaagcaggtggtttatatgactgaatagaaagcagaatttttccttaaagagtttctcagaaaagagggcaacaccttccatttaagttcttacgaaatatcctatattatgttacattctctcaatttttttatttagagcaataaagtactgttcaaggaactcacattagcctgaaaggacctcatagaatgcatggatgcttgtagagagcatctattggaatcagtaaaaaacggagacaaagacatttaaaaacctttaataatctgtgttttgggggctgtgacctcacagaggaaagggctggatgcccttgtaaacaggtttgtttgtttggttggttggttggttgggtttttttgagacggagtttcactcttgttgcccaggctggcgttcaatggtgcgatctcggctcactacaacctccacctcccaggttcaagcgattctcctgcttcagcctcccaagtagctgggattacaggcatgtgccgccatgcccagttaattttgtatttttagtagagacggttttcactatgttgatcaggctggtcttgaactcttgacctcaggtgatccccccatctcggcctcccaaagtgctgggattaccagcgtgagcctccatgcccagccgtaaacaagttttaaaagtagatggggagccaggcatggtggctcatgcctgtaatcccagcattttgggaggccaaggctggcggatcacttgaggccgagagtttgagaccagcctggtgaacatggcgaatcctcatctctactaaaaatacaaaaattagctgggcgtggcatgtgcctgtagtcccagctactcaggaggctgaggcacgagaaccacttgaacacgggaagcggaggttgcagtaagccaagatcgtgccactgcactccagcctggagcctcaaaaacaaacaaaacaacaacaaacacaaagtaaatgggggaatggtgggaaagagatggaggccgaagaacaatgctgattacaaagttcacttcaaaagcaattctgctaagtaagtggcttacttccctggtcaaagcaactgttatctcttgcctgaaactactgcaacagccttctaaatggtgtctctgaacccctcctatccatctacaatcttctgtccatgaacatccagagtgatcttttctttttctttttttttttttttttttgaggcagagtctcgctctgtcgcccaggctggagtgcagtggcgcgatctcggctcactggaagctccgcctcctgggttcacaccattctcctgtctcagcctcccgagtagctgggactacaggcgcctgccaccacgcccacctaattttttgtatttttagtagagacggggtttcactgttttagccaggatggtctcgatctcctgacctcgtgatccgcccaccttggcctcccaaagtgctgggattacaggcgtgagccaccgcgcccagccagagtgatcatttcaaaattcaaatctcctacttaaaaacctgtaatagatttgcaactgatctttgaataaaaatcaaaattactaatgactttaaaaaaaaccttgaatccttagtctctctctctatcttttttttttttttttttttgagacagggtcttgctctgttgcccaggttggagttcagtggtgtaatcatggcccactgctgccttgatctcctgggctccagcaatcctcacacctcagcctcctgagtagctgggactacgggcatgcaccccatgcctggataattttttaaaatttttttgtagagaagtctcattatgttgctcaggctggtctcaaactcctgaagtcaagcgattcccctgacccggcttcccaaagtgctacgattataggcatgagccacagcaccgtctcaagctttccttaatggcctttgttagaattatagttataactataaactctgtaagggcaagatacacgttaatttttgctcacctttgtctttccaacagctagcaaagtacctggcacaggtaatttgtaagcacttatgattatttgaatacatgaacaaatgagatccttcattgggaaatgaattatctacccagtggtctaagagagtaagctttaatatttgtactttttggcttctggaactccatactttactctgagccctggcatcatgagaattgatcatccagtttggttaagaccattcagctctaccattctggaatcaaatacctgttcagcttacatgatgccttatttgaagatattcatttctaggtgtccacatcaaacaggtcatcaatgactgacatctgctgtctgattctctgaaaagtccttcatctccacctaagagagcaacctgatatttaccatatgagaattcttcccctcagctctcttggtcaccaacgatatgggtcgtttgtaggttctccaagttcttctcatggttaagggcatttcaggtgccctgcttggaaatgatagctcagtttctagtatttgtagagaaggaacataaaacttggtgcagcacatacttcaagaaatcttggagaattaagtgttgcttctcagtatctcactccagtacagaactccagttctgtagctttacacctcatgttgtaagcatgaagagtaacttagagttatcaggcggcttcatcagttatatagaaaaaaatgtatattttccttctgtataactgatagaatccagctctctgtagtatgtactttctataatctgtttgtggagtaaagctgagttaatagcaattgtatctcacacagatacattgctctgtgtcatgtgtcttgcctattacttccttggagaaagttatgaaaagttgtgtcctgtacagagacgccacgatgctctacatcttccatgctacttccttactccctggtcacaggcctaactcagagttctaatcctactgaacacttcattgtctaaatgccccatttacatcttcttcctctctccctgaaggctttcgtagattgtgtattcaaaagatcactgaatcaaaaagaaaatcaccattctttattttttttcctggcacttataatcatccaacataatacacatattttgtttacattgtttattgtgattcccttcactaaaatgtatgcttcagggatccaggaatgtctgtctgttttattcgcagtagtagtattagcagttagtatagaatctaaaatatagtaggtgctcattaaatatttgttgaatgaattaatgatgccaaattgatataagaaaggatattcaagcataactttaccatgcacagggtttttcatcatttcaaattgctgaacaaaattctcaaagttaaaaaacaaaaacaaacattactactttggaagagaatgtaggcatttagaacaaacaagatgtagaattagggaatttatactaaaaataccaccgaagagtgagcacttggagacaatctacatgtatccatatgtcacacatgtgcctgggctttggttgctagaaataatttccctgaataatttctggggaggggatgtgtttataaatgccctccttggcagagcacggtggctcacgcctgtaatcccagctctttgggaggcggaggtgggtggatcacaaggttaggaccatcctggccaacatggcgaaaccccatctctactaaaaatacaaaaattagccaggcatggcggcactgtgcctgtagtcccagctacccgggaggctgaggcagaattgtttaaacccgggaggcagaaattgcagtcactgcaacccagcctgggcgacagagtgagactccgtctgaaaacaaacaaacaaaaaatgcaacaaacaaaaaatgccctccttgatctgcttggctctgtcttcctctcaggatctcggtcacttggctttcttccttgccagaggggtattaggagatggtagctgagtccagggttttataaccaagggaatagggagaggcaacctcttggtggtgaggactgggctgcagcagcagtttccggaacctactttctcatgactgaacgtatgcaggctctggcttccccagtggcttcttggagaagtcaggtaacgactcatgggagatgaattatttattcttcttctgtgtcctccaacagattattgagacccatacagccattccagagatgttctcatttgatcaggcaaccagttgtgtttctttgagaagctgtagccccgattcctccttctctaggatggtactcatcttcctccctctccccacatacaataaaaatgagctctatgagcgtttttttaggttctgttttccgggtaacccaagctagagcctagagaagagggaagtattctgaaacaactcactttcaaaagattacatgaaaccacaggcatgtcttagggttcaaatcttctttcatgtgccttgattcaaaactgtatatttctacttcaatatagttaagatattaatctgtagcaaaagtcaaataaccgtaaaatgaaaaactggtagaacttcaagtgaagactggaatagttggagatgagttgttgtagtcagaaagacccttttgtcaaattcattcattcattcaacagaatgccaagtattaatctaagtgctagagacacaacagtgaacaagacatatggatccttctgaaaggagcttaaaaacaatgtggggagacaaatgataaatacaaaaatactcaatattggtcgggcacggtggctcacgcctgtaatcccagcactttgggaggccaaagcgggcagatcacttgaggtcagaagttcgagaccagcttggtcaacatgtcgaaaccccatctctactaaaaatacaaaaattagccaggcgtggtggcacgcacctgtaatcccagctgctcgggaggctgaggcaggagaattgctggaacccgggaggcagagattgcagtgagctgagatcgtgctaccgcactccagcctgggtgacaaaaagagattccgtctcgaaaaaaaaaaacaatataatatcaaatagtaatcaatgattagaagaaaaataaagaagagagcatagagagtgatgagacactcttttaggtagcatcatcaggaaaggcttctctgggaaggaaacttaagcagagatcagaatgagggaggtatcagtgtagaagtctatgaaatagcatctactttagccacatatactcataggttgtttgtcagattcgctttgaattgagaataaataaatagagaagagaaggagaaaagtttttgcctttcttcttctttttttttttgtcacaaaaacatctaagcctgaatgtctcctaaattattctttgtggctggttagtcaatttagccaaagttgaaggtacttcctccttcttgaatgcaaaattacttctttttttctttttgtttttttaatagagacgaggtctatgttgcccagactggtcttgaactcctggcctcaagagatctgtctgcctctgctaacatggtgaaaccccgtttctactaaaaatacaaaaaaaaaaaaaaaaaaaaaattggccaggagtggtggtggacacctgtagtcccagctactcaggaggctgaggcaggagaatggcatgaacccaggagcagagtttgcagtgagctgagattgcaccactgcactccagcctgggcaacagagtgagactccgtctaaaaaaaaaaaaaacatctgcctacctctgcttcccaaagggctgggattacagatgtgagccactgcaccctgcccaaaattacttctagtcttattctagccctacactctgtctggtattattgctatttatttgcacatctcatatccatttaatatggcatatgatttttcttttaagaggcagaggctatgttgctctgttgctatgttgcccaggctggtctcgaactcctgggctcaagggatcctcctgccttagcctgccaagtagctgggactacaggcatgtgccatggtgcctgactaatgtggtatatgttttgaaagcaaagtctatatatttttagcattatagttcttgaaatatctagtacagtcctgtcacaaagtaaatacttatttgttgaatttaaatttagacagagtttcactcttgttgcccaggctagagtgcaatggcatgatttcagctcaccacaacctgcacctccagggttcaagcaattctcttgcctcagcctcccgaatagctgggattacaggcatgcaacaccatgcccagctaattttgtatttttagtagagatggagtttttccatgttggtcaggttggtcttgaactcccgacctcagatgatccgccctcctcggcctcccaaaatgctgagattacagacgtgagccaccatgcccagctgattttttaaaaaataaaatatctggactcagacaagtttacctaacctctcagagcctaagtgtaaaattgttattcctgtaaaaatcagaaataataatcatttgacagcatttattggtacaagaaaagagaaccgggtgtggtggctcatgcctataatcccagcattttgggaggccgaggtgggcagatcacttgaacaaagagtttgagaccagcctgggcaacatggtgaaacccagtctctacaaaaaatacaaaagttagctgggcctggtggtatgtgtctgtagtcccagctactcaggaggctgaggcaggaggatgcttgagcctggaaggttgaggatgcagtgagctgagatccagcctgcactccagcctgggtgacagagtgagaccctgtctcaaaaaataaataataaaataaataaataaataatctagtacaggaccagatacatggtaatatttaataaattgttggtcattcaatcaagaaattaagcatttttaaaggcttgatctgaaaccaggttatttgttcatgtaaagaatgtggtagttatttgttaatagcatttgttgttagttatttcccataaggaaatgatgatgtcatcacaagatcttttccttaatcagctttattaaggtataaattaattataattacatataattaaatataacttacatgtaattaaattcaccaattttcagtgtataatttttgacaaatgcacaccgtaatcagcatcacaatcaatatgtagaatatttctctcactgtaaaaagttcccttgtacctctttgaaagcaattttccccttctaccctcagcccctggcaaccactgatttgttttctgcaaaagatactttttactttataagcaaatatttatgagggccttccatttttgtttgttttttttgagacggagtctcactctgtcgcccaggctggagtgcagtggcgcgatctctgctctctgcaagctccgcctcccgggttcacgccattgtccagcctcagcctcctgagcagctgggactacaggcgcccgccaccacgcctggctaattttttgtattttttagtagagatagggtttcaccgtgctagccaggatggtctcgatctcctgacctcgtgattcgcccccatcggcctcccaaagtgctggctcacgcctttacatgcccggtatgagggccttctacttagaagtccttgagctagatagatacttcatagaatacaaagataagtaagactcagtttatgtccttaaatagctaaaaatctagtctagtcgtatgtaattttgagattactctgtctacacataatatgggactgaatttcaatatgaattatgcccactaaagaagaataaggaagaaaaaatattgtaaatggttcctgaacttttagaatagtaaacaaaagattcatgagtgccactaattaattataatttattttaaaaggcacaaatttatgattacaggatttccagataatttttaaaaagtaaactctttaaaattaagtaacatacatacaggaaacaaaagtgcagaaatcctaagtgcacagcttgatcttttcagattatttatggcaacctagaccagcactgtgtgaccaatgcagtaaaaagacaacatcctgaagtcttatggtttagacagaataattacatcactgtaagaaagaaagagataagagaataatgttctgcaaaggctcacaaagaattgtggggataagtagtgagaaaatggatggcacattaaaattcatgaggaaatgccgtttaacttctatgaataacaaagcgattattatgcaggatcaggtttttctttcatcattacagaaagacacaaaatcattatcgtgatctgccatatgtttttcctttgttatcagatgctgggacaggcctattaaatgttctgtgttacccaggggaatggtcagggcggtgagtaatgatggtcacgatgcatatggttttctatagtcctaattgtcagtgcatttagatccgaggaaaggaacaaattaaaaagggcagaatggctgggtgagcactttcttgtgattgcaaagaactgggtctattcttaccctttctgccccttgctttatgctttacacctgccatttccagactgacaaggcgctttggtggcgccttggtcaatgcaatggggactacaattaatttaaaaaggggtaatgcatgcaaatcgcagaaaaatattaacaccaggagaaaaaacacagtgtggaaaaataatcctacaaaaatgtttatagtggggtcaaacatttacccacattataattccaatacatgcaaagaaaatactcctttttaatttctatcatggacctaatttttccttgcaagcttccaccttgctctataataagaggaaaaaaaccaaccaaacgttaaacttgtcattccaggcaacaatctttttttagtttaaatagtttattttggccctgcatggtggcttacttctctatttaatcccagtgctttgggagaccaaggaaggaaaatggcttgaggccaggagttcaagaccagcctgggaaacatagcgagaccccgtttctagaaaaaatttaaaaattagctgggtgtggcagtgcatacctgtagtcccagctattcaggaggccaaagcaggaggatttcttgagtccaggagtttgaggctgtagtgagctatgattgtgccactgcactccagcctgagtgactgagaccctgtctcaaaaaatataaataaataaataaataaatagtcacttttgaataacaaattttcttttggttaaatccagaatctttcacatttcttcctgcttccctctgcttctgttcaaaataatgtctagctgtacagagggatttgtgacctagggtggcaaggagaggaagggcctcagatctatgtgggggtctcaggatcaaatttgtctctataccagagtgcatgtttaggggagccagagatcaacccccttttgctcttagtggcctcttcagctagatctagaaaccaaattgacaccaggcagattaacaagggaaaagcaaacaaattgtattagttctacatgtacatgggggtattcacaagagcatgaagtctgaataagtagccaaagcaagatgcttttgtatttttagacaaaaaatgttacatttgaaaagaaatgacagaacaaagagtatctggccaggggcagtaaattttctaggggagtcactcggacatgtatggaggatgtaaaacaggtggaagaaaagggttacttcgtcaagtacatttattcgatccattgcagcctccaattctttttttttttttttttttgaaatggagtctcactctgcaccccaggctggagtgcagtggtgcgatctcactcactgtaacatcctcctccaaggttcaagtgattctcctgccttagccttccaagtagctgggactacaggcgcccaccaccacgcccggttaatttttgtattttagagacggggtttcatcatgttggccaggctggtcttgaactcctgacctcaggcaatctgcccgcctgtacctcccaaagtgctgggattacagtcgtgagccaccccgcctggcctgcagcctccaattctaagtctctggtgataagggtttgctcgctctggtatgcagagggtgcccctcccagaggcatctgtatctcttgctgcatgaaattacaatttctcaactgttttcaatttcaaataattactataccaatccggaatattttgggatggcacattcttcactccttcacatatctctgactaagttatttacatagtagaaataagttctctattatatcagaaaagttgcaaaagtaatttatttctattgttttttatttaatgttttttatctaccatgtatttactttttttatactttcctaccttctattgagttactgatttatttttcacccttactgacttgaaagttatgttaaaaaaattaacctttacttattatcgattaaaaaggagtttctctgataaaaaagtggggtttcaggtttataacgtaaagctttatgtgatatagaaaaatgtatcagtaaacaaagcatgttgttttcttacaggcttacacaattttgaaatcaatcttttcctcattgtaattacatagaagcttaaaatttttttaagtttgttttatccatttttccttgtatactttacctttggtggcaagttcacagttaccaagtatattttcttcacagtggtaaaattaacaagaacttacttttgctttttttatttataagaacaatatcacttccttttactgaatcaatgtttactcttaaatttgtaacatgcatggctcaacttggtctaagatactgtcagcctcttttgaacagtatacaatctgagaaactttattcctcccattcttcctgttattatagtaatttggtttcaccttttcaaaaaccctctcaacttagagtattaatttatttatttttatttttgttttattttttatttatttatttttgagacggagtctcgctcttgttgctcaggctggagtgcagtggtgtgatctcagctcactgcaacctctacctcccgggctcaagcaattctcctgcctcagcctcccgagtagctgggattacaggtgcacgccaccatgcccggctaatttttgtatttttggtaggacagggtttcaccttgttggccaggctggtctcggactcctgacctcaagtgatctgcccgcctcagcctcccaaagtatagggattacagatgtgaaccaccgtgcctggcctgagtatttattattattgcttttattttgttttattttgacacagggtctctctctgtcacccacactggactgcagtagcataatcacagctcactgcagccttgacttcctgggcttgagcagtcctctcacctcagcctcctgagtagctgggaccacaggtatgtaccaccacatggcactaattaaaaaaaaaatttttttttgtagagctggatcttgctatgttgcccagactggtctcttaactcctggcctcaagcaatcctcctgccttgggctcccaaagtgttgagattacaggcatgagccattgtgcctggtctattattgctttttaacagttaatattaatatagatttaccagtatttttactaacttctctgttcaccattagtacttacagcgggtcctttctcctgggtttaatttcttttctttctctctctctctctctccctctctctctctcctctctctctctctctctctctctctctttctttctttcgcaggcagagtgggcctggtgcagcagggctgaccaccagtttactttctttcattttaagtgtatatttgtgttttttttttttttgagacagagtctcgctctgccgcccaggctggagtacagtggcgcgatctcggctcactgcaagctccgcctcccgggttcacgccattctcctgcctcagcctcccgagtagctgagactacaggcgcccaccactaagcctggctaatttttttgtatttttagtagagacggggtttcaccgtgttagccaggatggtttcgatctcctgacctcgtgatccgcccgcctcggcctcccaaagtgctgggaatatttgagtgtattttttaaagcaatgacttgttactatatattattttagtatttgtcagaaaatatcttgaattctctcttgaatgttagtttgagtacagacttcttgattattttcgcttaacaatgtggagatgcccatcattgtattgtcttttccatttttgttgagaaatctgctgataatgtgttattgttccttcgtaggaaattttttgtttgtttgttttttgctttttgagacggagtctcactctgtcgcccagcctgggccacagagcgagactccgtctaaaaaaaaaaaaaaaaaaaattagccgggcttggtggcgggcacctgtagtcagtcccagctactcaggaggctgaggcaggagaatagcctgaaccagggaggcagagcttgccgtgagccgagatcacgccactgtactccagcctgggcgacagagcgagactccgtctcaaaaaaaaaaaaaaaaagaatttctctctttccagcgtggtccatgtttcattttggtcaggtgtatatggtttttaatttttcctgtctggggctcagtgattatctactcaaatattacttctttcctattcaaatagacattttccattactctggaactccttttagacatctattgaggcttcccatcccatcctccatttcctcacaggatactgtacccacagaatagctttgcattttctcgggaatttgcattccctcttcatttctggcatctgaagattcttatattttatcaagcatatctatatttttgttgcatcagatgagactggatcatccagatttaactcaccagactgcttgtagtcccatgcagcaaaaaaggtaaaatttctgtctaatttacaattaaatgaagaggtatagctaacttaatatgtaaagtaaaaattatgcatctgtgcaaagtcttagaattatgaattaaaatgtcagcattttggtaatccctagtgtctagactgtttcctttttgtgtgtgtgcttactttataatgagattgtaaacccagtggcattgggtaaaccttagaggtatcttgtaagaattctgtttaattttgctttattgaactttatgtactagaagggaagcaccaaaaatgaaattttagataaaagcctactattgaagcaattgtctatatttaatacatagaaataaagttagtgaaacatcaatatgaagcccataaacagttggcggaaaaagcaatggcctagagatttgggaagctgtaccctagactttgctctgcctctatgctgtatgaccttgggcaagtcattgaagatcttaaagtcttggtttcttcatctctacaaagtggggatggcagtctctatagtttaaaattgcattattctagatagtgcagagatagacagtgtcatttgaaaatgtcttaaaatcctgatacttctaatggaataaaatgaaagggataaaaaccaagacatggccaggtgcagtggctcacgcctgtaatcccagcactttgggaggccaaggcaggtggatcacctgaggtcaggagttcaagaccagcctggccaacatggtcaaaccccatctctgttaaaaatacaaaaattagctggagatggtggcgggtgcctgtaatcccagctacttgggaggctgaggcagaaagaattgcttaacacccaggaggcagaggttgcagtgagctgagatggtatcactgcactccagcctgggtgatagagtgaggctctgccttgaaaaaaaaaaaagaaccaacatcatacaaattgttccttttaaatagggtgtaatgtttggaaaataaagtaaaaaaaaaaatcaaccaaaaaaagttgaagaaactctcagacaagacctatttcagattttaattgtaaattttaagagtataagtcccttctggcccggcacggtggctcatgcctgtaatcccagcactttgggaggccgaagtgggtggatcatgaggtcaggagatcaagaccatcctggctaatatggtgaaaccccatctctactaaaaaaatacaaaaaaattagccgggcgtggtggcaggcgcctgtagtcccagctacttgggaggctgaggcaggagaatggtgtgaacctgggaggtggagcttgcagtgagcagagatcatgccactgcactccagcctgggcgacagagtgagactccatctcaaaaaaaaaaaaaagagtgtaagtcccttccttggctaaaattttcacttatggaaaaaaatggtgctagaacaattgtgtgtgtgtgtgtgtgtgtgtgtatataggtgtgtgtatgtatgtgtgtgtgtataccttgacccataccttgtgccatgtaaaaacatcaactcaactaaacatgcattgcaaatctcaatgtaagattctataactataaaaatacttgaagaaaacattggccaggtgcagcgactaatgcctgtaatctcatcacttcgaggctgaggtgggaagatccattgagcccaggagtttgagaccagcctaggcaatgtgaaaaaaataaacagtctctacaaaaaaaagtacaaaaattagccaagcaagaggggagggatagcattaggagatatacctaatgtaaatgatgagttaatgggtgcagcacaccaacatggcacatgtatacatatgtaacaaacttgcacgttgtgcacatgtaccctagaacttaaagtataataaaataataataattttaaaaaaattagccaagcatggtggcacatgcctgtagtccaatttctcaggaggctgaagtgggaggttcactgagcccagaagttcgaggcttcattgtgtgatcgtgccactgcattccagcctggaagacagagagagatcttgtctcaaaaaaagaaaaattaaaaataaataaaggaataaataagaaaatatatgaaaacatctttgtgacattggattaggcaaagatttctaagataccacaccaaaagcacaatttataaaaggaaaaaaattggtaaattgaactttatcaaaattaagaactttttgaaagacacaattaagaaaattaaaagacaagacatagactaggccaaagtatttgcaaagcatatatctgacaaaggactagtattcaaaatgcataaagaactctcaaaactcagtaagataataagcaacccttcccacacacatacaagtgggcaaacgttttgaacacacactttatgaaaaagttgtatggactacaaatcaataccttttgtaaaaatatgtttgatattgtcatagaggtatgcaaattaaaactgtaataagatactgttatcagtggaaggtagtccaagctaccggtggcaaatccgtatgggtctacggcaacctcagttcttgcctcctcagaacaaataattcgactgaggggcataaggcagaaaaaaagatcgaggcaagtttcagagtaggagtggaagtttattaaaaagctttagagcaggaaagaaaggaaagtacacttggaagagacccaaatgggcaccaagaaggtcaagtgcgacatttaaccttgatcttagaactttattttattttattttattttatttttgagatagagttttgctgtgtcactaggctggagtgcagtggcaggatattggctcactgcaacctccgccttccatgttcaagcgattctcctgcctcagcctcccaagtagatgggactacaggtgtgagccaccacgcccagctaatttttgtatttttagtagagacggtgtttcactatgttgtccaggacggtctcgatctcttgacctcgtgatctgcccgcctcagcctcccaaagtgctgggattacacgcattagccaccgtcccaggccaatcctagaactttatagactggcccacttctggtgtctagtacccctttcccatgatatttcccttagggtgggctgcccgcaggcgcaataccctctatatgcttgggaggtgagcacgcacagtgtgtttaggaagctgtaggcgtgcccatccgaagctttctttccttttccagtggagtgcccaggaaggtcatactccgtcattttgtttcccaatgtgcatgcctgtgaagttgcctctccctggtgtctgcattcaactaatcttttagagcgacaggtgtaaaccatcaggaaatggcctctccctggcaatttatcagcctctcatcaacaatattgatgatgaatgatttaatgactggtaactggctctgtgataattactcaaatcttaatatctggacactcaaaaagaatgagaagaaattgtgatgatgatatgatatcttttacttttggactgaaagttaggaatttctctaagttttatgatatggccatgccatctaattatgccaatgtgtcactgctgccaatttgtcacttttagaaaggcaatatgataattgccgaaccatttcctgacattcctggtgggtggggagagctctctcctgctctgctcatgcctgtctaactacctgtaacaataccattatctcctattagaatggctcaaacaaacgaacaaacactgacaatatcaagtcctagcaaggatgcagagcaactggaattttcatacatggctgatcgaagtgcaaaatggtccagctactttggaaaaacagtttggcagtttcttagaaacatatatttatctttgacccagcaattccactcctacgtatttaccctagagaaatgaaaactttgtcacttaaaaacctgtatatgaatgtttatagtgaatttgcacataatcacccaaaactggaaacaacatagatatctctcaactactgaattaataagtaaattgtggtacatccatacaatggaataccacttaataataaaaaggattaaactattgatatacactacaacatggatgaatctcaaagcaataatgctgaagataaaagaaggcagaccaaagaaggagtacatgctatacaatttcattcatatgacatttcgggagatgctaaactatacagacagaaaacaaattagtggttttgagggcctggaggtaaaggaaggagcggaccataaaggggtacaagggaatttgttaaagttatgaaaccattttttatcttatatttatagtggtggttacacaaccatatgcacttgtcaaaactggtaaaactcaaaaaactgtaacccttttccagggttttccttttccagaacacattatgaaaaagcacccagttgtgccgggcgcggtggctcatgcctgtaatcccagcactttgggaggccaatcacaagattaggagatcgagaccatcctggctaacatggtgaaaccccgtctctactaaaaatacaaaaaattagccgggcgtggcggcgggcgcctgtagtcccagctactcgggaggctgaggcaggagaatggcgtgaacccgggaggcggagcttgcagtgagcagagatcgggccactgcactccagcctgggcgacagagcgagactccgtctcaaaaaaaaaaaaaaaaaaaaagataaagaaaaagaaaaagcacccagttgtaactgctggagtttttattgtttcagaaaagttcaagggaccgggcgcggtggctcaggcctgtaatcccagcactttgggaggccaaggcgggcagatcacaaagtcaagagatcgagcccatcctggccaacatggtgaaaccccatctctactaaaaatacaaaagttagctgggcatggtggcgcgcgcctgtaatcccagccactgaagtggctgaggcaggagaatcgcttgaacccgggagctgagatcgccccaccgcactccagcctgggcgacagagggagactccatctccaaaaaaaaaaaaaaaaaaaaaaagttcaaggaagaaacccagccacagcaaaacaaaaaccagttggatccagagatgcctgagttggagatgaactttggagatttctcctcattagcatactaaaaatccacccaggaaggagctattctccatttgtatgtagaggcgtgatcgcagactgggcctgagctggctctactccacctctacatatgataactcagctaacctgcctaataaaagcctttttatcacctttgtttagggagacactgctttggggatttatccccgatatcctccttacttattgtaagtaataaaatccccttgttaaatcttccttggttgtggtattggactgtcactggctaagtgatcaaacccacccattgtgtgggtaacaaaactatacactaaaactataacatttggaaattatgccccaataacctgaccgccccctcaaaagccttctcacaatgcttttcacagattttttttttttgagatggagtctcgcactttcgcccggctggagtgcagtgctgagatcttggggctttgcaacctctgcctctggggttcaagcgattctcatgcttcagcctcctgaatagcggggattacaggcgcgcgacacatgcacagctaatttttgcatttttttagtaaagacggggtttcaccatattggtcaggctggtttggaactcctgacctcagatgatctacctgcctcagcctcccaaagtggtgctgggattataggtgccaaccaccgctgctggtctttcctcagattttaatggtaatacttgacagagcaggaacattgccatcttggacaagcactgctattctaaagttccccttgatcaaaaactgcctaatccaaaaggcatcagcctaatggctaaggtcagcatgaccataaaccgcaaatgacatctctgaccggaaaccttccaaccataagataaacccctccccgactggagagatgtcagccccaagataaccttccctccaaccagagacattccaaccccgcaataaacttctccccgacacagaaatattacaagcctgtgataaattctcttgccctgaactcttaaataatcttagtctgtaagagagggcccctgactgaaatcggccaaaagcccctctcaggcttattctctaaaataaacctgtctttgactgttgagccgcttttaatgtttctttcctctttctttaattcttacaatacttaaatatgtaagctccttttttttcctatgaaaaaattgtatcataactgagaaatcaataaggacaataaaaattaagatattaaaataaggccaggtgtggtggctcacacctgtaatcccagcactttgggaggctgaggcaggtagatcacttgaggtcaagagttccagaccaacctggacaacatgacaaaaccctgtctccacaaaaaatacaaaaattagccgggcctgttggtgtacgcctgtagtcccagctactggggaggctgaggcagaagaattgcttgaacctgggaggtggaggttgcaattagccgagatctcaccactgcattccagcctgggtgacagagtgagactccatctcaaaaataaataaataaataaataaataaatataaataaaatggaaagaatttgcaatacaaaatctatgtgccttaaggtaagtcctactaaagacatgcagtaaatgtttatttatgtttcaatctgtttcactttttgattttatgagttaaatgtcaatgaaaaatttttttcagagaaatagtactgtttcatttttcttttaaataatgttgatctgaaatttctcaagtaaacccagcttgccaccttcaggtcactgaaagatttacagagactatagtcagaacactaatactgcatctttctcaataatccataattaataatatcttgatcactctattgtgcctttgtcaaatgcactctatctagaatctttccctagcatttactggaatcttcccaactttcaaagctcagttcaaatgtcactaactcctagaagccttcactgatcactctagctagtttttcctcctctaaatattttatttccttgattacttgtaatctcactgaaggtaataaccatgtcctacacatattttatgcctctgcgtggctattaaaaaaggtgcatataagaattgtgcattctagctggacgcggtggctcatgcctgtaatcccagcactttgggaggcggaggcaggcggatcacctgaggtcaggagtttgagaccagcatggccaacatggtgaaaccccgtctctactcaaaataaaaaaattagccaggtgtggtggcaagcgcctgtaatcccagctactcaggaggttgaggcaggagaattgcttgaacccgggaggcggagattgcagtgagctgagatcatgccattgcactccagcctgggtaacaaagtgagactttgtctcaaaaaaaaaaaaaaaaaaaaaaagaattgtgcattataatatttactgaatgaacacatgaatgaataaataggaagctagagtaaacattgagctttcacttggaagaggtcccattttactagtaaattaacgggaattctacacatttattaaagactatatgcatacatataaaagcacaattttcattgacaactagcagtgtctcaatctctattaagctctcaaacaatattgttgatgaatgatttaatgactatttggtgactggctttgtgataactactcaaatcttaatatctagacatttaaagagaagaaagtgtgatgatatcttttactttttttttttttttgagacagtctcactctgtcacccaggctggagtgcagtggcatgatctcagctcactgcaacctctgcctcctgggttcaagtgattatcatgcctcagcctcctgagtaagctgggatcaccggcgagcgccgccacggctggctaacttttgtatttttttgtagagatggggttttaccatgtcggtcaggcttgtcttgaactcctggcctcaggcgatctgcccgcctcggcctcctaaagtgctgggattacaggtgtgagccatagcacctggctgctattttttacttttggactgaacgtgagatatttctcttgttttgtgatatggccataccatctaattattttcctctaaacccccaagttgctaatatactataagcttattaataaaatatgtaaccgtggcatgtagtccaccaatacatgactcagaaaaattcccaaattttttgtctagttccatttagtttagggcatgaggttttctttcatgtttacattctctctagaatgaagttcccctctctctctttcaaggtctacatgtatccaggactactagatgaaaaactggtcatagatgtttgtttctggttttttaatggagaagggaatggtccacacttgagaatggtttatctccttgaattccttccattagaattttctttctttcttttttctttctttccttttttctgaaacagggtctcactctgtcacccaggctggtgtgcagtggcaccatcacagctcacactgcagtcttgtcctcctgggctcaagtgatccccctgcctcagcctcccaagtagctgggaatacaggcatgcacctccatgcctggctaatttttgtattttttgtagagatgagtcttgagatggggtctcactatgttgcgcaggctggtctcaaactcctggtgtcaagtaatccttctgccttggcctcccatcgtgttgggattacaggcatgaaccaccacatctggccccattagaactttctaacaaaagatgatctttctcctgccccctagagggctgtttatcccttctgtcagtccttcctttctcattatatcctctccactctctgccctctgcctaggcccagccttatccatctgagagaggaagtaaccagtaatttgagcatgcacagaaggctctgatttgggacctcatgtcagcagtgtctttggatttttgtttctgctttgttgagggctgaacaggaagataggcccatgggttaccagtgagatagaaaaaggggaggaaaatacagagaaacaatcggattcacattttgggatacaaatccaccacaaatgcaagtttataatacctatgtgggctaaaagtttgttctctctcctccagtcctttatctttcctcaaaatgtgaacttggtatttctccctcatcagtatcagtttcaactctcctaaacaaatcttctaattgtaccccaatactttcattgaccaagtcttctcttaatcaccacatacacactgtagtagcggcatctttttccagctattcttttctctccctttcatttaccctagttgattctaaccagccatccccaagtgtattaggtacattttcagtttgctcgcgaattctcatttactcacaatatggcttctgtctgcttccctttaccaagacaagtcttgttttggtccaattaatgagcttttaaaaaatccatgtagcttgataccattgctcactccttctgtgaacaattaggttctgttattaattaggtttgtacatatcaccatttttctagcattttaaactttctggttctgactgtaataatatctttgataattttcctttttttttttttttgctttatttactccttttaaccatcacaacagtggtcctatacttttctttctttcctgaagatgattttaaaattccattccatttttgtaaatctgtaatgttgagtctcttttggatgctctgaaacaggttgcttggattgtggaatattttgaaagactgcttatgaggcaatagcagcagggtgcaattcagacttctcacacttctttaaataccagttctttcaggagtttttttttttttttgagacagagtctcactctgttgtccaggctggagtgcagtggtgagatcttggctcactgcaaccaccacctcccgggttcaagagattctcctccatcagcctcctaagtagccgggattacaggtggctactaccaccctaggctaattttttgtatttttagtagagatggggtttcaccatgttggccaggctggtctcaaactctcaacctcaggtgatctggccacctcagtctcccaaagtcctgggattacaggcctggtctcaggtttttaatgtaacccaaagataagaaatagattcaatgtcgttagggacactgacctttcttcccagattcaacccatttattttctatttttactctgtacttgagttttgtttgtcattgtaatttgtaaactcactgggtaggaaataattgttgatcttctaatttagaatagccccaagcacatggttatcatggtaacatgctttaaatgtccttggttataaaatgaacaatgttaaacatcacttgaatttttcacttttatttttcttcattctttgcttgcaggttttatattctatactctcaataggtggttctcatacaagaatggggtcagttctattagagttacaaacattggaagaaaatacattattttggtaccaaaatctaaatacttccatctcccaatgcagtttagtggttattagtgtgactttgaatcttggccctcttagttctttgttttgtcaccacaggcaagtttctaacacaaaaattagggatagtaataacctaactgtatgagtttttgtgaaaaatagaggaaataatttacagttgaaacctgaacaaggtggggttaggagcacgagccttttgcactgtaaaaatctgcatataactcttttctttttttttcttggagacagagtctcgctgtcacccaggctggagtgcagtggcgcgatcttggctcaccccaacttccgcctcccaggttcaagtggttcttctgcctcagcctcccgaatagctaggactacaggcacgcaccaccacacccagctaatttttttgtatttttaggagagatggggttttgccatgttgcccaggctggtcttgaactcctgaactcaggcaatctgcccaccttggcctcccaaagtgctaggattacaggtgtgagccactgcattgggccaaaatctgtattacttgactccccagagcttaactgttaataccaactattgcctggaagccttaccaataacataaacagttaattaatacgtattttgtatatgtattatatactgtattcttaaagcaagctagagaaaataaaacattaagaaaatcataagagaaaatatatttactattcattaagtttaagtggatcatcataaaggtttccatcctgttcagtaggctgaagagaaggaggaggaagacaaagggttgatcttgctatctccagcttagcaggtgcagaagaaaaaatctgcctacaagtggacctgcgaagttcaaaccagtattgttcaagggtcaactgtatcagaaagatttgactactatgagctaagtggtaatcatcattggtctgaaatgatgatttttagaaagtgactttattatatcactgatagagatgccctatactgaaatactgagattaccaataccttgcctgtaccacaaatgtatttttgccattttgctttctgtttctataatattttgaattcctaacatgatccagaaggctgggagatgctcctaatgaaagagagaaacctggaatgttctcctatttaccagattgcttcctctcatacccaggttttgagatataaagttgttacaaagttccaacttatttggtatcattcaaaatctgatgagcttgcattttaagaagtgttgatcagttccatttaaaagcagttggtatgagttcactttattttttgaggtggaatctcgctctgttgcccaggctggagtgcagtggcatgatcttggctcactgcaacccctgcctcctaggttcaagcgattctcctgcctcagcctcccgagtagctgggattataggcgcgtgctaccacacccggctaattttttttatttttttatttttaatagagacggggtttcaccatattggccaggccggtctcgaactcctgatctcaagtgattcatctgtcctggccccccaaggtgctggcattacaggcatgagccaccatgcatggccatgacttcacttcaaatgagcacagaaaaatctgggggcccaacaaccttatggtacatcttttgaagcctggtcagacaagagggtctttaggtgatggtgaagtgacagttttgagttgtcttctttggtagtaagtgttggctaattctaacagcaggaacaattgaggagtccaacaaacaatcttgttcacattgcaatgattttgttacagttgacactaatttaaaaattggcaggctctagaccagaaagacctgcccccaaagtaccttttctgaaaaagttgccctgcctcagatgctgtgtatctgttgaacttttcagctactgtggtttccaaggaatgcacctctatcaaaaatgagcttaattcctaaggaagtcaattattattcctccattccagcaaagtcaacaaatattgacagcccaccttgaatcactgtgctgggccctggatgtagcagtgttttaatatttcgactcttgtgggggggggctttacaatctagctgggcagaagaggaaacatgcaaataaattaaaatgcagggtcctatgagggaaatgaacagccttggtgacctaagttttgataataacataactaaaagttcggctccacaactcagtagctgtgtgccttggacaggtcatatcagattaggaaaggtgagaatgagttgaggaacgcagcactctgggatcatggttccagctccgggcagagggttacatcgtgtcaagtgtgtgaaggcagaatagcctgcagagaccactgtggcgttgaaaagaggtgtcgtcgcgaccttcggcgccggagaggcgaaacaagagggggtcttcgggccctcaggtatggctcagccgcccaaggcgaagcgcacgtggcagttggcgggaaatccctggggggtggagcctcggctcgaggtccggccgccccgtaccacgtcatcgagcagctccccctccccttgctacaagtcgcacgcgcggaagtaaacacctctacgtcatcagggcgcgtcctcgtctttcccctcccatctcctcagatcggtggacgtgctcgcctccactcggggccaggtctatgtcccggtttcccgcagtcgcgggcagggcgccamggcggcaggaggagggtgagcggtcaagagacctccaggaagagcggctctcggctgtttgcatcgccgatagaggtgcggtccgcgggacggtacggaagccagcgggagttacggcgtgggggttttggtggggggatgaaagtacgcctttggcaggctgagaagagtagtgaggaagccgtggcgttctcctggctttccaagcccgaggcgaactttgcgtccaatgagcactttgccttagaggggggcggtcccagattcaagttaggcgaaaaccttactggggggcgaaaaagtgaaccccaacgcccgaaatgcattctgttcttaaacaggctcatagaccctttgttctctacccattcatcccccccacccttcgtcgggccgccagcctgcctttgggtacagtatgaagggagccagtttccaggagccagtttccatggttacccaccacttggccttctgggatatcagtcgctctgaacagggacctaacttgaaccatgaatcagaagcaaacacaggtggcttctaatccagctgagaattttctgctgtgttccagtttttggtctattgttaaataaaattgagttttgtgcttctgtgtaagtatgcatgtgtatacgttgccttgagctatacttgctttgaaaagtactttgagttatgcgtgaacaaatgctcaagttgctggatttcaccaaaaagttgttctgggctcattaaccctcacttacaaattgcgctcattaacgctcacttacatgagcgatttaactgagaagtcatggatgatcccgtccagccctaaaattctattgcctttctggttttagtcatgagaaattgagtcagagatatctttacaagtcttttaattgacttgtttttctgttattacagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcaggtgatttttttctgttgtaataattggaaatattttaaaaatatcctctttttaaaggccagtaggacttctgtactccatgattgcccagtatttgctttatagtcccgcttctcttggcacacccccttcccctatgtctcctttgcttctttatggtctatttcaggttcaagaattagttgggatggcaaattttcccatttttaattaccataataatctcaaatagaattacatctagatattccattttatagaataaagttgtctagcagtagactattaaccattggatactgaaataattttgaggggtaagagatatgtgatatctgttgctgccattagtacttcttggttctttctctagagcattatcaggtaaatatttatcccctgactttgccagcgcaagccaactaacaaattacctttaaaatacgttaagtaaagttaataggaggcctttggtttggactgatcccccgcactagacccaacagaccaaaccaaaatggagttactcatactgaagttccacgccaccaagtctagaaactaaatttttcatctactgagaaatcaggagaaagagataatagccaaatccccaaacagaccagttttaggagcatcaagaagtttcctctgctttaactttgacaagaaaagtaactttgaaatgagcaatctgctttttgttttctgtttctgctttcctcagcccttttctgtctatacaatcagcctcctctgctcagctcattggaacactgattctattttatgagacgatgggttgatgtgattccagagttagaatcacaaaagccaattaaaaagttttggctgggcacagtggctcacgcctgtaatcccagcactttgggagcccgaggtgggcggatcatgaggtcaggagatcgggaccatcatggctaacacagtgaaaccctgtctctactaaaaatagaaaaaaaaaaaattcgccgggcgtggtggtgggcgcttgtagtcccagctactcgggaggctgaggcaggagaatggcatgaatctgggaggcggagcttgcagtgagccgagatcgtgccactgtactccagcctgggagacagagtgagactccgtctccaaaaaaaaaaaaattttttaggccgggcgcagtggctcaagcctgtaatcccagcactttgggaggccagggcaggtggatcatgaggtcagcagttcgagaccagcctggccaacatggtgaaacccgtctatactaaaaatacaaaaattaggcgtggtggcgggcgcctataatcccagctacttgggaggctgaggcgggagaatcacttgaacccaggaggcagaggttgcagtgagctgagaccgtgctgttgcactccagtctgggcaacagagtgagactctgtgtcaaaaaaaataaataaaaataaaataaatttgttgtaattttgttttttgacaagtgtcattcagtatgacagaactttctgtcataaggtttgtaaagagcagtattatattggatatgatttgccttaaaaaataacaaatgtattattctaatgcttcaatctaaggtgccatctattaagatatatcactattttatgtgcagtaatcccttcttatccttgggagatgccttctaagaccactcaatgcctgaaactgccaataataccaaaccctgcatatactatgtgttttcctatacatacatacatacttttgataaagtttagtttataaattaggcatagtaagaaattaacaacaacaacaataaaatagagcagttatgacaatatactgtagtaaaacttttgtaaatgtggtctctctctgtctctcaaagtactgtaacatttttggacctccactgactgtaggtaactgaaaaattggaaagcaaaaccaaaggtaaagagggactactgtattagtaagaatggaaatgcgccatcgattttaagatgcagctccattcccaaatatattaaaatggtatatggaaggtgcatatatatatatatataaatatagatatatatatttatttatttttttgagatgagatcttaytatgtcgcccaggctgatctcaaactcctgagttcaagcaatcctcctacctcaaccttctgagtagccaggctcctgagtagctgggattacaggtgtgtaccactgctcccagcagaaaggtggcatatttaagtccagttttaggctgggtgcagtggctcatgcctgtgatcccagcacattgggaggctgaggcagatggatcacttgaggtcagaagtttgcgaccagcctggccaacatggtgaaaccccatctctactaaaaatacaaaattagctgggtgtggtggcgcgcacctgtaatcccagttactcaggcggctgaggcaggagaattgcttgaacccaggaggtagaggttgcagtgagccgagattgtgccactgcactcccgcctgggcaacagagcaagactctatctcaaaaataaataaataaataaataaataaataaataaataaatccagttttactcttgtggcaaaagtaaatttattttgggaagtgtgtggaattttatgaattcttatgtttcaaaattcttggcttacctttagagtagatttttagacagaaaaaaacagacaaagcctgaattctaatttaaaaaatatattttttacaaaaaaattagctgggcctggtggcaagcgcctgtaatcccagctgctcaggtggctgaggcaggagaatcgcttgaacccaggaagtgaaagttgcagtgagccgagatcgcgccactgcattccagcctgggcaacagagcaatactccgtctcaaaaaagaaaaaaatatatatatatctatatatatatatagatatatatataattttttctttctttttttttgttttggctgggcgtggtgtctcaagcctataatcccagtactttgggaggcagaggcaagtggatcacctgaggttgggagtacaagaccagcctgaccaacagggaaaaaacccgtctctgctaaaatacaaaattagcccggcatggtggcacatgcctgttatcccagctactcgggaggctgaggcaggagarttgcttgaacctgggacgcagaggttgcggtgagccgagattgcgccattgcactacagcctaggcaacaagagcaaaactctgtctaaatatatataatatacattatattataatgtatatttatatataatatatagtatatattataatatattataatgtatatttatatataatatattataaattatataatayatataatatgttatatattaatatatataatatataatatattataatatatattatatattaaatatatattagtatataatatatataatatataaatatatataatataaactggatttatattatatatatttatatattatatatataatatatttttgcatggttattaatatgtattattttaaattaatatttaaatttccatgatgcaaacatagcagtgtgtttttaatttgcgagatattcttttggaaacattcaagcagttttgtgttgattggccaaaaacaatttagctctaataggaagacaattgctaacattgttgtgtttcttyatctctggttttgatagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggtacaaaagtcttgttggtatttgtttcttttcttttatgggacagggtcttgctctgtcgcccagcctggagtgcgtggcgcaatcatggctctctgtagcctctaccttctgggctcaagtgatctcctacctcagccccttgggtagctgggactacaggagcatgccaccatgcccagctaatgttataaacttaacagaaagagtggagagagttctgaaagatttttaacttcaaagttcaatatatattttaaagaatttatttttgttgttcattgttaatgctttagctctcaagtgtctgatgttcatcccattttctccttccttagtttataaatgacagtttattttcttaggattctcttatttatgttttttaactgtaaggattcttgacatgtaggtttttaaaatgttttwttgtagtaaaatatatataacttaaaatcgaccattttactattttggtatacaattcagtgccattaagtatgttcacaatgggctgggctcgatggctcacgtctgtaatcccatcactttgggaggccgaggcgggtggatcacctgaggtcaggagttcgagaccagcctgaccaacatggagaaaccctgtctcttttaaaaatacaaaattagctgggcacggtggtgcatgcctgtaatcccagctactcaggaggctgaggcaggaaaatggcttgaacccgggaggcggaggttgcggtgagctgagatcgcgccactgcactccagcctgggcaacaagagcaaaactccacctcaaaaaaaaaaaaaaaatgtgttcacaatgttgggtaaccatcaccatttctactttcagaactttttttatcatcccaaacagaaactcttatagattaaaacccccatttctccctccccctagcctctggtaacttcttttttttttttgagacgaagtctcacaccattgcccgggctggagtgcagtggcgcaacctccactccctgcaacctctgcctcccaggttctagtgattctcctgcctcagcctcccaagtagctgggtttacaggctcctgccaccacgcccagctaattttttgtatttttagtagagatggggttggtctcaaattcctgaccttgtgatctgcccacctcggcctcccaaagtgctgggattacagggtaaaccaccgcgccctgctgtatcttctgttctactttctgtctctacaaatttgcctactccgggtacctcattcaagtggaatcacacaatattttgtacttcgtgtcactcttatttcactgagcatgttttcaggttgatttattttatgtgtttgtattcttgaagtcaatggaaagctgaattaacaaaatcagccaattaacaaaatcagcaagtgttaaagcatcttctatattcatggcaccaacaaatttaaaattttctttttaatagtgaatattataatttacattccctgtggatttcttaatcctgtccagctacaaaacgatccctggtttacatatgttccctaatgggaatggccatcaaatgtggcacaagatgactccccaaaatactatctttttgccttcctagtggtcactgttttttctttcttctttcccttgttttatggatgtcgttgctgttattcctaccctttggacctttttctcaccctgttttaatgcttgttgagtaacacatttttatttggagatagtgtcttactaagtcacccaggctggagtgcaatggcgtgatctcagctcactgcaatctccgcctctcaggctcaagcagtcctcccgtctcagcctcccaagtagctgggactacaggcgtgacccaccacacctggctaatttttatatgtttattagagatgtggttttgctatgttgtccaggctggtctcgaactcctggactcaagtgatccgcccacctcagcaacccaaagtgctgggattacaggcgtgagctaccgtgtctgacctaagtaacacattttttaatagagaagaggagagagtgggtggaaagtatgcacctaccattttctcatttcccccgaatcctctaaaataggggctgagtcagaaagataaatctcatttcactgttgtttcccacaacttgcttacccaatgccattgcatcatcttgccactttcctctgactttattgtatttccttattggtgatttttgttgctttgtccaagaatacccaagtgagttatttgtccctttttctgtatagacagcatgttttgtaacttaccatcattttgtatacataagttagactatttttatgtacccttttgtttagtcagaktggtttgatcacttaatgtttgtacctcttgaggaaaaatttagttgggaaaatagtggtgaattcctgtgacactgctgtttgaacattaggagacagcaatcaaatatatgactgatggatgtttactgaaacatattctgggagacccaaatcttaccaaattcagwgtcattattttggatgaagcccatgaaagaactctaactacagtgagtattttaatttattattatttttttattagcaagtagtttgtttgggtagctttttattgtgtagagaattgcctcctcttactttttaatttaatttaattttttagagatggagtcttgctccatcacccaggctggagagcagtggcacgatcatagctcactgcacccttgaactcctgggctcaagtgatcctcccatctcaacctcctgagttgctggtactgcagacgtgcatcaccatgtctggctaatttttaagaatattttttgtagagacagtgtctcgttttgtttccctggcaggtctcgacctcctggcctccgaccttggcctcccaaagtgctgggattacaggtgtgagccactgcacctggctcctacttatattttaatgtattaaaataggaattccttggttagaatagcagtgtatctaaaatagtttggctgttaagtgtacttgtgacttactagaaatttacttttctttcaggatatcttatttggtttattgaagaagctatttcaggagaagtctsctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcggtattacttggcattcatttaatgtcttttttaaatatctatgattcttactaattgggtggtttgataattcatttgttcactactattttaatgacagtcctcacaggtcctagaacttttaagaaccaaatttaatttttctgtggggcaagggaagtggtggtaagggaatgactgtatttccactagcatattatgcctgcatttcttgctttagattgtgaaagtcaccatggatatccatttgaatgaaatggctggagacatcttggtttttctgactggtgagcattcagtatcaagttaaaaaacttaagtatttgtaagtaaggaatgtggcacccagatagagtgctacctctgttgggaattctgtgcccttctcaagtgttgccctagctttttctgattatctgaataattttaggtaaaagatagataaaaattgtaagctagctgccaaagaggattatatatatttatgtcaaagacataatagtatgtatatatattttatgtcaaagacatagtagtatatgtcaaagacgtaatagtgtatatgtatatatacacacacatatatgtcaaatgtcaaagacatcaggctcattagtaaatatatgtaaaacacactgaccttttaatagaaagaaattaaatagtgaaatattgttttttgttggtctgtcttagatagaaatgwaacctgactaaacagacctgagttaattccattatttcaaaggacatttcaccaggttcttctttgggtggtggcattgtactgtgtgataacaacacataaggtgtagaatctatgtgtcgtagacaagcatgtggcatttttggagatcaaaaataaaatagttaaatcccaaactagtggcataacttttcaaatagcagcaccctcctaataggaattagtagtttccttgtttacctttttcctctgccttgtactaatgtcagaagtragggattgtcacaatctttgcctttttggagattacttaagtattttgaaatttaaccaaatgcaatagcacctggactagcttttctcctttgttaacaatttggtgagtcttctcaaatacagggtgaaaagcttgacgatgataaatatttttattcctttagagatttargtttcttagaaactgatgtttcttctacttcgaattttattgttgaaatatggtacagcttatgtgttcatctcctttacattaaatgagagatttacaataacttttaggcaaaattaattttaatcttgacattttctttatttttaaattaatttttctgttcagttgctgaagttatttttttcttcccattttaggccagtttgaaatagaaaaaagttgtgagttactttttcagatggcagagtctgttgattatgattatgatgttcaagataccaycctcgatggcttgttaatattgccgtgttatggatcaatgacaactggtaatttctcattagaatagaaaatttgatttttttaaaaaactttttattgaataatcgtgtttacagaaaagcagtcagatcttaagtgcttaggtaagtttcacaaaccagtctcacctttgtaacccacatccagatcatgaaacaaatcagtgagaaccagcattccttgacagtagtgatttttgcctgaagtctttttacattcacttttttgagagtcgtggatatcccccttattatcgtttagagtattgtttctcccagcaaaacaaaactattggtgagaattctttgaaatgaggacagtagtttcttgctggtattactgtaagtcaaaacctaatttgccattgccacagaatttttagaaattgtgtatatccagctatatctaagtctaaacacagtggattgttttgttttttttttgtgatggagtctcgttcttgtcatccaggctggagtgcagtggcgcaatctcagcccactgcaaccgccacctcctgggttcaagcgattctccttcctcagcctcccaagtagctgggattgcaggcgctcgccaccacacctggctaagttttgtatttttttttttttttttttagcagagatgggattttgccatgttggccaggctggtttcaaactcctgacctcaggtcatctgcctgccttggcctccagaattgctgggattacagatgtgagccaccatgcctggctgtggatcattttccttttaaagtagccatgccttagtctgcttttcaagaatgatcctgttctttggtgaattccaagagcaaatgcaaactcttgatttgacattttggttatagtaaatattgttgaatgaggtttagaatttgttttataaaacttttattatggaatttaacttgtaaagttaaagggaaattaaccttagcctcctatttggagttggaattagcatttgaatgtttttatattttacatgtatgcgtattaacagcttttgttgattgggtgattcttatccctatattaacaaagttttggaatatatgtgtcagtaaagaacatagatgtgctattttggaaatcttttttatgatgatattagcttcttactctctattraagcatagatatctattttagattttgtcatcttcagggaaattcttaggatcattgtttaaggttctcattgttttctcaagatttggttcacygatgcttttataatttacattgaaactgataaaaacccattatgtttggtttgttattaatcattaactaaatatgtacatagacatatattattctatacagagtaaataatttcattctttcttactgctacattgaaaataatgttctggattttctcttgcctctgtttttttttttttgttttttgagatggagtctcgctctgtcgcccaggctggagtgcagtggcgcgatcttggctcactgcaacctctgcctcccagattcaagcaattctcctgcctcagcctcccgagtagctgggactacaggcgcgcgcccccacgccctgctaattttttgtatttttcttagagacagggtctcaccatgttagccaggatggtctcgatatcctgaccttgtgatcctcccgcctcagcctcccaaagtgctgggattacaggcgtgagtcaccacgcccggcctagaaacatgacttgtaatgaaaaattaagttcttcaaaactcgagtttgacacatgcatgttgtaaattggtattttctttttatatatacttcagatcaacagaggaggatatttttgccaccaccacctggaattagaaaatgtgtcatatccaccaatatttctgcaacgtctttgacaatagatggaatcaggtaaaacttttgaactttctcttaaagtcaaggaagcctatcgttactaaacattagctaaacattactgagtttgcttttctgtgccctccactaattcccttctctcctactttttgatgttcttaacatgtaatcacctattttgttttgtaattattgattgctttgagcaggaaatggagtaggaggtacatactatattcctattcacactttttgtttttttagagacagggtctcattatgttgctgaggctggaatatagtgactattcacaggcgtgcagtcatagcacactacagccttgtatggagatcagccaatcctcccgcctcagtctcctgggtagctgggaccacaggcatgtgtcaccrtacttggctgttcacactttttaactacttggcaacttgaagcttcttttcaaatttaagattatgtataatgctttatgggtttcactaaataggaagccaaacctatttttctgtactcccattataagcatataccttagatgatttgatatttccttctaccttgcagcctcactcggtagagttagtttgtatatccartgtttatctggatgtattgtctctgactttttacctttttgtgaaaattaactatgattcaggtcccttatcttttctggatgtagtaaatagtgctatcaaatttttgggtaaatttagtaaggaaacacwaagaaattttaagtctggactgacaactaatgcaaagttctttaagactgggttatttatcatttaccgaatatattttatttctttagctaagtctgattgtctgtctccggaaggctgaacctgaatctcaaagatcctgtgtgtttcttctgggtaaaatgatcacccaggtctgagaggaagtctaatttcctctgcttttcttcgttactttaaaaataatggtttcactaagggattaagggagtgctctcctgggtaaattaacctctgtaattttctgtttcctgcacaggcaaaagccattaaatagcatgtttcagaatgttgtcttgttactgctatcctactttggttccttacctgacttgttcaccatttaattggcttagaatggcatgttaagggctagttgaaattagattctgaatctgtttaaatggtctgaagctgactttcaagtttgtgtatttttgtattgaggcaaaattcacataaaattaatcatttaaaatgaaaaattaagtagtacttagtacatttacagtattgcgcaaccactgcttctgcttagttctaaaatatttcaacacctcaaaataaaaccccatacccattaagcaggtactccacattcccctcttgaccccagcccttggcaactaccagtcttactttttgtttgtacgtattttcttttttaaaaaattctttagatgtgtcagcaggaagcagtaggtattttctattctggatatttcatacaaatagaatcatataatatgtggccttctgtgtttgctttctttcacttagcataatatttttgaggttcgtccacattgtagcatgtatcagtacttcattcttttttgtggctgaataatattgcatagtgtgtgtgtgtatatatatatatatattccattgtgtgtgtatatatgcgtgtgtatatatactacatacatatatgcaaagcaatttgttcatcccttcttccattaatggttaatggacatttaggttgtttttaccttatggctgtgattcatagtgctgatatgaacattggtctataagtatttgtttgagtacttgttctcagttctttttggtgtacacttagaaatggaattgctggatcatatggtaattttgtgtttaacttcttgaggacctccgaacaattttccacctcggctgaaccattttacattcccaccaacaacatacgagggttccaatttcttgactttcaagttttacacttaacataaaaggcattgtgtacctgctagtttgctagaaaaggagaaaccaaagtggttaacaattaacaagtcttcttttattttccagaaacttaacttgctttgattcttcttagatatgtggtagatggtggcttcgtgaagcagttaaatcacaaccccagattagggttggacatcctggaggtggttccaatttcaaagtaagtctctatgtcaaatctttttattcaaagaacaactgattaggtaatttctagctgttttggggagacaaagtaaattacctgagaaacccacagaacattttggggaatttttgggtttttttccttttgtaggagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtatgtagacaactagaaaaaaaaggaaaaacttgttagcctggaaccaagttattggctcaaaaattattttgaaatatttgactgatacatccctgagagttgaggctaacctcttttacaggttggtttttatattggttgcttttcttttctttttttttttttttttttttttttgagatggagtcttgttccgttgcccaggctggagagcagtggcacgatcacggctcactgcaacctccgcctcccgggttcaagcaattctcctgtctcagcctcccgagtagctgggactacaggtacctgccaccatgcccagctaatttttgtatttttagtagagatggagtttcaccttgttggtcaggctggtctcgaactcctgacctcaggcgatccacccacctcggcctcccaaaatgctgggattacaggtgtgagccactgtgcctggctctattggttgcttttcaactaaactaacacagaagacttccttgcattgctttagtaggatctcttgctcatgtttaaccttggcttaatggcggggttagggggttgtgctgatgtttatgtggatcacttagtgaccactgtttatttgtaatgaaaggtatataatgagctgggcataacagcttatgcctgtaatctcagcactttggatggccaaggtgggagggttgcttgagcctaggatttcgagacaagcctgggcaacatagtgagaccttgtctctacaattaaaaaaaaaaaaaagtctgatatggtgcatgcttgagtcccagatatttggaggctgagacgggaagattgctggagccgggcaggtagaggctgcagtgagccatgattgcaccactgcggtccagcctgggcaacagagtgagaccctgtttcaaaagaagggggctgggcgtggtggctcacgtctgtaatcctagcactttgggaggccaaagtgggcggatcccttgaggccaggagtttgagacccgcctggccatcctggcaaaaccccgtagctactgaaaatataaaaattagctgagcttggtggcacgtgattgtagtcccagctactccggaggctgaagcacgagaatcacttgaacccaggaggcagagactgcaacgtgccaagatcacaccactgcactccagcctggtcaacagagcgagattctgtctcaaaaaaaacaaaacaaaacaaaagggtatacagttggaaagtggagtgttttttttgtatggccagcatcatactatataccatgaaagacagagtaatactctgtagttttttgctttcactaagcttaagttatattaggaaaacaaggttcagacacgtgaaataaaggaagaacagttaaattagccaaatattaatataatttattggtataagatagaatattgttatagatagaaatttctatcatacatggtaggggaattaatggaggaaagtactatcttctttattttggtcttaattgccttggaatgtaaaactgctcaggaattttgggggatggtaaccgtgcagtttttaaattcatagtaagtgattattaggtgcatccaaatatgtattgtaggccgggtgcggtggctcacgcctgtaatcccagcactttgggaggccgagacgggtggatcacctgaggtcaacctggccaacatggtgtaaccctgtctctattaaaaatacaaaattagccaggatggtggtgctcgtctgtgatcccagctacttgaaagcctgaggcaggagaattacttgaacccgggaggcagaggttgcagtgagccgagattgcgccatcgcactccagcctgggcaacaagagcgaaactctgtctccaaaaaaaaaaacaaccaaaaaaagcaaaaaaaaccccaaaacccacaaatactcattgtatactcttggaaagccaatttgccaatttcaaaatgttttgatagttatcattagactagagattttctgaatgagaatatgtagatactggaaagagaaaagcatgtaataaatgaaattctgactgtagcaataaattataccaatgaaaagaaggaaagcgccatttaaagaaatccaaagagcccaatagaaaactttcagatgaacccagatattaaaataatgtcttgatttttttcatttggggaaaaagggccatttttggaaatagctgctcagtaagtttgacattgactcttagtatattcacaaaggatagcagagcagcctctaaccaagaatgagtatatattagaaaaataggaacaataattaatatcatctgcattgaattatttttccatcttaagtcttaaaagccatagtgtactaaaaatcgcaaaattwtgtttcaaaatgcttgaaacaaaaaacaaagacttcctttttaaaaagttgtataaagaataaggagaggtagagccagtgtttggggtagatggtataggattcatagacgacagaaagaaaatggaccttctcaattattattttgctttccctttcttttccatcaggaagaataattttaaagctgaaaatgcaagaacaggtctgaataagaaggaattgatgactaaggtggaaggaaataatgagggaaaacctaccaccataagtgattttgtcttgagcatttagacattatttccgtggtgttaaaagaacttgcagatttagcgtcagagtcactgtaggtcatctatgagaaattatgcagaatacgttatcagaaaatggtgagaaaggcaaaagtcttaatttttttcatttggtaaaaagggcgggttctggaaacaactacccagtaagcttgacattgattactagcgaactctagtacagtttattgaaaaatggtttaaggaaatttaatgacgattaatgagtatgaattttaaaagttcacaatgaatatgtcattttttgttgttgttgtgtttggttttggttttctgaggcaggatctcactctgtcacccgggctggagtgcagtggcacaatctcagctcactgcaacctccacctcccaggttcaagcgattctcgtgtctcagccttctgagtagctgggattacatgcgtgtgccaccatgcccggccaaatatgtcattataagccatttccttttcagtttgaggacaggaccgtccacataatgggtgctccacaagaatttattgaaatttaacctaatgtcttttattttcagcacagtatttaacaatactgcatttgatatcttgtgaataaaaaagtagtctgtagatgacagtactgctgagtatagttgccagatagcccagtctagaaaagtattaattaattgcttagtgtagactagatgaagtttttactggtattgtgctgaacttagttttttcttgataaacatttttaatgatactgaataaaaatattgaagttatgattatatttttctggaaaatatcttaatatctaataggtagatgaccaagctttaaaatgactttaacagattagaaccatgggcaaaaatcaacagggtgtaaatttgaaaggatatatcttatatcctgtgtttgggatgtacaatagcaaatacatgtggtagagatctgaaattatcagatcatcacaaccttaatattggcttatacgtatggctctgtttaaaaaatttttttttaggccgggtgcggtggctcacgcctgtaatcccagcactttgggaggccacagtgggcggattgcgaggtcaggagatggagatcatcctggctaacacagtgaaaccccgtctctactaaaaatacaaaaaattagctgggtgtggtggcagacgcctgtagtcccagctactcgggagactgaggcaggagaatggcgtgaacccgggaggcggagcttgcagtgagcccagatcgcaccactgcactccagcctgggcgacagagcaagactctgtctcaaaaaaaaaaattttttttttaattccactggcatagactttggttacattaataaactaggtgatggggaattacagcattcctgttatgtgttggtcactcaacatttggagttcagttttggatataatcaagttttatgaggagtttgacatactagtgtttttagagaatggtacttaggtatggtagatctcttagaaaccaagtaacttataaggagtggttgacagaattggtaattggaggaatcaaggggggaaattaattgcaatattttagaataagtagtttttccttttatatagaagaagcagctgactggtttggtattgctctagcacaagggtggcaaactgtggtctaatctcactgactgtttttgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttcttcctcttcaaaattgtttaggccattctgggtctttttcatataaactttagaaccagtctgttgaaatccacaaaataacttgctgaacttgctgggattttttttttttttttttttgagatggagtcttgctctgtcacccgggctggagtgcagtggcctgatctcggctcactacaagctctgcctcccagattcgtgccgttctctcgcctcagcctcccgagtagctgggactacaggcgccygccacaacgcccggctaattttttgcatttttagtagagacagggtttcactgtgttagccaggatggtctcaatctcctgaccttgtgatccacccgcctcagcctcccaaagtgctgggattacaggcgtgagccaccgcgcccggcccttgctgggattttaattgggattatgttttaattaagatagattaagttgcgaagaaatgacatcttgacagtattgtcttcctatccatgtacatggaatatctcttcatttatttagattgccagtaattcattgagcatttactgagggtttaccgtgccttagccctaggacagaaaactaaggataaacaagttttgttgttgttgtttttgagatggagtttcactcttgttgcccaggctggagtgcaatggtgtgatctggactcactgcaacctcctcctcccaggttcaagcgattcttctgcctcagcctcccaggtagctgggattacaggcatgggccaccacgcctggctaatttttgtatttttagtagagatggggtttcaccacgttggtcaggctggtctggaactcctgacctcaggtgatctgcctacctcggccttgggattgcaggcatgagccaccacgcccagcccggcgttaatttcctttcattagtaaaggaagatagtgcttttatagtacattagtaatttactaattttttttttgtaggatcaaaagaaaaggtagtttagcccttgcatccttagagaattcttttgaagtttccaggtctttaaacttctgcttctttcttttcttggtgtgtcagtataggacacaatttaatttgacatatgttagatttgttttcatgcagtggagtaattttttctttcaaggagcttccaagtgaacagtataccttgtctgcagccagacaacagaatgggttagctcactggctttatacctttgtaggctggaagtgtcgggtccagattaatttattattgccatgattataatggaggatacatttttctataaaaatactctaatcaatatactgtttcaaatagtttgcagtctttttttttttaatttaaaaaatttttaaattttattgagacaaggtctcactgtgttgcccaggctggagtgcagtggcgtgatcttggctcattgcaacctctgcctyccaggctcaagtgatcctcccatacctcagcctccccagcagctgggaccacagatgcttgctactatgcctggctaattttttgtatttttatagagatggggtttcactctgttgcccaggctggtctcraactcctgagctcaagtgacccaccagccttggcctcttaaaatgctggkattacaggcctgagccattgcacccagcagttgcagtctgaartgtcagaattttaattctrgtaatacccctaattgcaattttttgttctaataaaatgctgtataaaaataagtaatgttaactggttttcatgaggcagtatcagagctaaaaataccagtgggcacagtggtatcccagctccttgggagactgaggtgggatgattgcttgagcccacgagatcagggccagcctgggcaacatagcaagaccccatctctgataagaaattaaaaaataggccaggtgtggtggctcacacttgtaatcccagcactttgggaggctgaggcaggtgggtcacctgaggtcaggagtttgagaccagcctggccgacatggtgaaaccctgtctctactaaaaatataaaaattagccaggcgtggcgtgcacctgtgttgccagctactggggaggctgaggcaggagaattgcttgaatccaggaggcggaggttgcagtgagctgagatcgtgccactgcactccagcctgggtgacagagtgagactccatccccaaaaagaaaaaagaaagaaagaaataaacaagctaaaatatttcaaaacctattacagagtattgaagtaggagttaagagtgcagggttctgtccagctccactactacctaattatctgaccatggccctagyttttctagatttcatttttcatttgtaaaaccaagaagttggattaaggtgaccaactctaatagtcttttaaggctagaaaaagaaaaatgttttttccatgttggaatatttaaatagataaaatcagtgtggtgttagccttttttgggtgacatttattcttatataatttcaaataagaatagcaaaggaattcctttataccttctatgcagtttccgcaatttttaacattttaccccctttgctttattactctgtctccctctatatatgtatatataaacagatttttttctttttctgaatcatttaagaataaattggaagcattgtgctcccttaccacaaaatatttacatctgtattaggcaagaacaagggcaatctctcatttaaccatagtacattaatcaaaattmggaaattgttttgttttgtttgagagagagtctcactctgttgcccaggcagttagtgcagtggtgggatcatggctcacygcagccttgacctcccgggctcaagcaattctyccacytcagcctccttagtagctgggaccacatgcatatgctaccatgcctgactaatttttaaaaattttttgtagagatgaggtctccccatgttgcccaggttagtctcaaactcctaggctcaagcaatcctcctgctttggtctcccaaagtgctgggtttacaggtgtaagccactatgcccggcctaaagtttggaaatttaactttgatacaatattaytatctaatccagaatccatattgaaattgtccattttccctagaatctacagaaagtagtttgagaattggtaagttatagtactgtgaaaaacaaccctatataactacagtttgatatttgtttacagttaattttaggtaaaatttacatatagtgaaatgcataaattttaggtgtataattcaatgaattctgtaaaatgcttatacccatgtaacccaagccctgtcaatatatagaacatttttatcactagcaagttccctcagtgccacttcttagtcagatatcactctacctacctttggttaaacacttttcttatttttttctgattagtttgcctcttctgaaacgtcatataaatagaattttttttttcttttgagacagagtcttgctctgtcatccagggtggagtgcagtggcacaatctcggctcactgcaaccttcacttcctgggttcaagcagttgtcctgcctcagcctctggagtagctgggattagaggtccccgacaccatgcctagctaatttttgtattttcagtagagacggggttttgccatgttggccaggctggtctcgaacccataacctcaggtgatccatcagcgtcggcctcagccttccaaagtgctgggattacaggtgtgagccattgtgcccagcccaaaacttcatataaatagaattatacactctcctttcttgtgtctggcttctttcagtcaacataatgtatgttaaggtttattcatattgttgtatgtatgaatactttattctttttrttgttgactagtattccactttatgaacatacagttgtgcattatcctgttgatggacatttgaattgcttcttgtttagttctatttttgagtaaagttgttttgaacattcttgcacaaaaatttgaaggtgtttattttcatttttcttagataaggtaaatgcctaagaaagaaatttgctgtgccatcgagtaggtatatgtgaatctttaagaaactgccaaaccttttccctgaacagttgtaccatttaaaaatcacatcagcaatgtttgagagtacagcttgcactaaacacccctctcaacatttggtattgccaatcattttattttacacattctattatgtacctctttgtggttttaatttgcattttcctgatgactaataatgttgagcacttcttcatgtgcttattggccatttttctgtcttcctttgtgatgtcttttaaaatattttgcccatgtctttttatttttgagacggagtcttgctctgtcgcccaggctggagtgcagtggcatgattttggctcactgcaacctccacctcctggattcaagcaattctccttcctcagcctcacaagtagctaggattacaggcttgcatcaccatgcctggctaatttttgtaattttagtagagacgaggttttgccatgttggaggctggtctcaaactcctgacctcctgacctcaggtgatccgcccaccttggcctcccaaagtgctgggattacaggagtgagccaccatgcccggccccttgtcttaaattaaaacaaaaaaaaamaaaaactttaattcgtggattctttcttctgccagcccagatctactgttgagcccctctatggcagtttccattttgtttcttgtccttgtcaactccagcggtcagtcagtgattggtcggaggttgtacctagctaagccttttaatttaagccagtgatgttttcaccttttactgttgaatctgtgtttctggttaggagactactttcatggttgagggagttgatgaatttgtactgtgttcagccaaggagtmgaggctcagacrttccctctctatttacttctcagaaggcacagctttgggcatgagaacaatcttctagaacaccaggaagactatgctcttagcaggtctctgtttccttcattgatttcttcattgaatttttggctggtctgtctctattggtgtcacagcaagctgttagtctccactgattgctagctgctggctctgttgtttttgacagtgcccagagcataaattgckccatagtcttgatccaaataaagttgggcacctcggcaggggcaaggtattgcccgtctttgataatcctttccccwtcctttcctggaaacaatctctgtgctatggagcaggagttggagagggtggtggtggtaatgggggcctgttcttcagtggctctcctatctgggtcctccctaaatagcagaagcttggggttggggagttaggagctgatactrtggctcactttgcatcttcctcagcacaaagccttttgagatgcaatctctggatgttcactagttgcaaacrtacaaacctggaatagctctaggaaactgggagtagtgggaactaccactgagctgctgaacccattggaacaactcttctgcaacacagagctgtggggaatagaggacwgcgtaggctgtcattakctgttatgctttgatcttccctaccgagtagcatttaggagtcagggaaagggtgccgctttcaggctgccttgaaggctctcgcatagcccttccacacacacagctgttgagagtggggcattcttcctactgtccttaccgaattccatagattaggcttgtcttaagcattttaatcaatctccagagactttgaatgattgtctttggtaattttgactagtttaatagatgtctctctagaaaagaagttttacctaactcctcacatcaccattcccaatacagttgacccttgaacacacaggtttgaactgtgcaggtctacttatttgtagattttttgttttttgttttttttttttgagacagaattttgctcttgttgcccaggttggagtgcagtggcacaatctcaactcaccrcaacctctacctcccaggttcaagcaattctcctgcctcagcctcccgagtagctgagattacaggcatgtgccaccatgcccagctaattttgtatttttagtagagatggggtttctccatgttggtcaggctggtctcgaactcccaacctcaggtgatcctcctgcctcggcctcccaacatgctgggattacaggcgtgagccatgcactcggccaattttttcaataaatatattggaaaagttttyggagatttgtgacactttgaaaaaactcacagatgaactccgtagcctggaaataccaaaaaaattaagaaaaagtatgtcatgaaaacataaactatgtgtaggaaatgctgcaggataattaaggaatcagagagaccgaggggttgaggaggagttatttaattatttaggtgcaccaacccagttggattaacatccaaaggactgagccctgaacaaagagtcaagctaccttttaagcatttcgtggggcggggggagatctgtgcagggggaagcatattacagaagtgagaaacaaagacagttatttaattaagacgtgcattacattatttcttacttttcaaggaacaacatgttttacgacttgagattatctgtctagtgaccttgaagctgcacagctcgagagtcttcacaatgcctgggaaggggtgagataaggctcactagccacagagagaaaaacaggcagttaattttaaaggactccagctctttctcttcctcggggaattgggttttcttacatacaactgagtttttgcttatamagtctttaatttcttttaattcctgttccagtactagtctgttttataatttactaccataaaatatacacaaatctattataaaaagttaaaatttatcaaaaatgcatgcaaacacagactgcatggtgccatgattctagggattccaggaggcactgactcacaggtaggcttttctcctggtattgmgagccaggatggggtcgatgctggagtctagggcaatttgacttttggcatgatatcttctgggggatggcagttaggtgcttaaaatgaaatattttgggttaaaaattagtatccctggctggcgtgttggctcaagcctgtaatcccagcactctgggaggccagggcaggcrgatcacctgaggtcaggagttcaaggccaacctggccaacatggtgaaaccccatctctactaaaaaatgtaaaaattatttgggtgtggtggtgtgtgcctgtagtcccagctacttggaaggctgagacaggagagtcacttgaacttgggaggtggatgttgcagtgagccaagattgcaccactgcactccagcctgggcagcagagcgagactgtctcaaaaaacaaaacaaaaaacaaaattagtctcccggagcagttcaagaaatggagattaataatcatttatatcttttccttaccagggtcatttgtatgtttgtatggtctgagataaatcrtattcttttttttttttttgtctctagctgcttcattcagttgctacctaggtaacatagttggaagctacttaaagcatgggatagaagactttataccttcatcagtgttttctttaatcaaattactttcctcctagtaacaggaactgctgctttgcagwttcacatcgtattctatagtaaatgctgctccctggattcaggcaacattgtgcctctgctagatctagctgtgataggtatagggaataggaattgtgatgtgacgtgttagattgaaggaaaggatccctatgcagttttgaaaaaatggcactctgaaagattagccctggataaagtgctgtatggggaatttgggcaatcagagagcacatgagtcctgaatgggatcaggggaagtggtatcgaagtaaktaacagataaatctcaaaaacgtaatgttgagcaagagaaaacagacacatcaagtacatactatacgattcatttatacaaaggttaaaaatgggcaaaacccatctgtaggattagaagtcaggatatagttattcttgtggaagggaatgggtagttactcgaaggagggcataaaagggggctgttgagatgctggtgatactgtttgttgatctgggtacattggtatgttgtgtttgtgaatattatatgagctacacacttacgtcctgtgtaattttctgtatgcatattatacttcaatattacattaaaaaagaaaatgttcgtagtaggtcagttctgcatatatggagatcatgtctaattgcccataattgggaattggataaataagaactggttaaattgtgttatgttccccatactcctggggaataccrtatcattgtttttttctttagacaaggtttcactctgttgcccaggccaaagygcagtgatgcgatcacggctcactgtagcctcaacctcctgggcttgggccgggcacggtggcttatgcctgtaatcccagcactttgggaggccgagacgggcagatcacaaggtcaggagatcgagaccatcctggctaacatgtgaaaccccgtctctactaaaaatacaaaaaattagccgggcgcggtggcgggcgcctgtagtcccagctactcgggaggctgaggcaggagaatggtgtgaacccgggaggcggagcttgcagtgagccgagatcgcgccactacactcagtctgggcgatagagcgagactccgtctcaaaaaaaaaaaaaaaaaaacctcctgggctcaagcgatcttcccacctcagcctcctgagtagctgggactacaggcatgcatcaccatgcctggctaatttttgtatattttgtagagacaggatcttgctttgttgcctaggcttgtcttgacctcctgggctcaattgatccacttgccttggcctttgaaattgctgggattacaggtgtgagctaccacacctggccctatattgctatttttgagaaagaataattctatatgtactgatatggagttgttattaaataaacaaattttcagattatatgttccatttatagaaaaatgaaacattatgtacatatgcttatatatacatagaaattacctggaaggacacacactaaataatgaacagtactttgycttgaggattggtttatgggtagtgtgactggggaacattgaacttttacatgatattcttttataccattacatttttttttctgtaagcatggattactcttataacaaaactaatttaaaaagtaaattacaaatactatttttaaaaggcaaatagattgggagaagtratgttgctattcaggtaaaatctccaaagtgatatgaaaagaaaaaaaggaattgtgggagaaatagagcttcctaagagaagttaagaagagttaatatagttctaccttacttcaccccagaggatgaggcagattttaatgagtttctgaaagcaaagtgattgtaggcacttaatgcaaagtataactgaattgcctctccaattcttttagttgatccagagtaccagaaggaagcagaacagagacatcgagaattggcagctaaagctggaggatttaatgactttgcaactttagctgtcatctttgaacaatgcaaatcaaggtatgtaaggtagtcctttgtcctgaaaaatgtcaatttgatgtrtagttccaatacgtacttatgatgtggcttgtgacactaacgttcagtgaagatgatattgacttcaaggtattttgaatttcagtgaaattatctatgtcagatgactattgcttagtaggcatttattatataacattgattctcttstttyctcctcaaacctttactgaaaatgaccttrtagaattttgcttctatataggtagcctagattaaaaaatgattggatatttgttattgcatatataagtaaagaaatccatttacaaattattttttaatttagtcaggggcacattcattaatttaaatgtttttttcaagtttcctaaaattcttttttagtacttggacaggtctcctgaaggaactgacagttgtttatgggtttccacttttgtaatagaaatgagaattttagattgtcttttacttagagaagatattttaaagataccagttttttgttttgcagtggagctccagcttcatggtgccaaaaacactggattcattggaggtgcttattttctgcatttcgtgtggaagctcaacttcgagaactaatcaggaagcttaaacaggtgattgccrtaatgttttttttcttgagtagcattttggacctatatatttcatattgaagtttcattgatgtacattagcaccctttctattctaccacccttccattctatttgtttctatgacctccttgaccccatgaaacattcctagtagtgataaaagaattgtcttcacagaaatgaagatatttaaaaattgctttcctgatatataattgacgtgtgataacctacacatatttaatgtatacactttgatgagttttgacatttgcgtaaaacaactatcaagataatggtacatatccatcatctcccagttttctcatcctcccccccaccyttttttttttttgagatggagtctcactctgtcacccaggctgaagtgcagtggcgtgatctcggctcactgcaatctccacctcccaggtttaagcaattcttctgcctcagcctcccaagtagctgggattacaggcttgcgtcaccacacccggctaatttttgtagttttagtagagatggggttttgccgtgttggccaggctggtctcaaactcctgacctcaagtgatccacctgcctcggccttccaaagtgctggaattacaggcatgagccactgcacctgtcctcattccctttcataatccattgtctcacctactaggccctcctgccccaccaacccaggtaaccactaatctgctttctgtcatgatacagtaagtcctcacttaatgtcatcagtaggttcttggaaactgtgagtttaagcaaaatgatatacagcaggccctagaaaaatattgttttattcaccattgttttaacactgatgagagaaaaaaaaaaatcttaaaaattttgcttaactttgcagtttttaagaacttatcattgacattgaagacttactgtatataagtttgcatttcctagcattttacataaatggaatcaaacagtatatgctcttttttttttggtctggcatcttttactcctcatgattattagtttttcaatttatatatcttattttggtaaaataattaatataaaatttacctctactgggcattgatgattaacccctgtaatcccaatgctttgggaggacgaagtgggaggaccacttgaggccaggagttcaagaccagcctgagaaacagtgagaccctgtctctacaaaaaaattaaaataattagcttgttgtgttggcacacacctgtagtgctagctactcaggaggctgaggcagaaggattacttgagtccaggagtttgaggttgcagtgaggtatgatgccactacactctagcctgggcaacagagcagcagcaccctgtctcaaaaaaatttttttttttttttttttttactgtttttatgcgtacaggtcactgcacacttaaaacatttacaatgttgtgcagcccttaccacttctccatctccagaacttttttttatcatcccatactataataaaactccataaccattcaacaataactccccattcccgacagtgcatggtagctcacgcctataatcctagcactttgggaagccgtagtgtggggatcacttgagcccagcaagtttgagaccagcctgggcaacacagtgagaccttgtctctactaaaaaaaaaaaaaaaaaattagccaggcgttgtggcacacacctgtagtgtcagttactcagcagggtgaggtagaggattgcttgagcctaggagatccaggctacagtgagctgtgatcacacaacttcactgcagcctgggtgacagagtaagaccctgactcaaaacaaaaacaaaaaaacctacccattatcttctttctccagcctctggaaaccactgttataatttctctgtttcgttatgagtgttttctgtttgccttatcttaaagttcattaatcttttctcctgcagtgtctagtctaatctgccattaatcccatctagtatatttgtcatctcaggtgttgtattttcatctctagatgttggatttcagtctttaaatttttacattttatttttcaggtctctactttttgaacatatgtaatccagctatacagaaaattataataaaatataattagatctgtgtcagttctaggttgattttgatagatgtcctcattatggattgtgtttttttgcttctttacatcatacctgataatttttcagcggatgccaaacattgtgaatttcaccttgttgggtgctggatatttttgtgttctagttacttggaaatggtctttggtctttcttgttgggtcttgcttgcatgatttgttaggtgggatcagagcagtgctcagtgcagggctagttattcccctctactgaggcaaggcccatctgagtactcttcctaacatcacatgaattactgtagtgtagtattctcatgtggcttataggaacaggcgccattactagccctgtgaaaacaccatgcccttacttatccttttaagaggttcttttcttgggctggtagtttcctcacattcatgtgctaatcactactcagctcaacacttgaggaggaccttctgcatctctctggagttgtgtctttgtgcacttctcttctctcctgaactcttgtcctgtgaattctagccaccttggtcttcctggactcccagctttctctccctaacccagggagttctctgagttccatttgggctttacttccctgtaccttggtctgcagtctttatcaaggctgaagttggggcagttgttgggcgtactgcgtttatttcctgtctctgtcctttattgcctgatattacagtgttttggaaatcattatttcatgtattttttccatttttttggtttcaggtggaagggtaaatctggtctctcttaatctatgttggccagaaacagaggtctttagaaatgtggatttttcaaaataaaagattatttcaaattgtactatgagatttaccactctctacatattctttttatagcaaagtgatttcccaaaagagacctttgaaggccctaaacatgaagtactacgaagatgtctttgtgcgggctatttcaaaaatgtagctcgaaggtaagcaataaagacttgagagatggatcaagatataatactgtatttgactataatattggactatttaatattaaacattgaagatttgatttaagctctgtgatgattatgacatgaattacagtgacgagggagagctacagtgacgagggagagctgcagtggctcagaatgtggtattagagctcaagtagggtaggaggggtatgtttgtagggtggctgtccagcatgggttatcttcacttaaggcaagtaacaagagttttctttcagagaggtggccctgtgtatagtgtgaaagccaagtaggttgagcatagcatccctgaggaagggtagcttggcatggagtgctagggcttgagcaaggtggggaggggttatttggtttggggcatcagtcagagtgtagtgaggaaggcatctttatagagaaaggggtaacagtgatggtgatggagattcattaaatacagaggaattgaacacataactctrtgagtgataatggtgaagggagttagaaatagcgaaagtgagaaaataggaatgatctctgtgctgttggattgaaatttcagtgtatcatgatgaagttatgggtttcattatagatggatgcatggatggacactggaataaaaatagatgttagtgtgtgtatatagaatgtatttgtatgtatgtaaatatttatatgtatatatgccctagctctgagataataacaatgaatagacatagtgcccagatcttgacttgggacatccatctgccacttaaaggagtcaggggtctttggagaaatggggctgggaaaatgcaagatgagcccagaatatcttattttgccagcaagtaaagaagtgattaacaaaggttgaggccaygtcagaagaacataggagccagcatgaagaggccccaagtaatcaaatatgagacactttaagcatcaaaataagtagtgatagtagcggattattatgcacttaataaaatgtgaaatcgtgtctatcgtggtataaataaatgagtaaaagtttattgagaaatggaattgtttacaagcacctctccataaaatttttgttaattacaaaagcaaaaagtaactttacagtggagaatcctggcatatgtgacctaaatcaagcaatcaaagtgaacataatgaaataaataaaaatcatgttcttcctgataggatacaatgagaaaaacacagcattatgtctgtgatattcctgctaaagatgcataacctgaatctaatcatcctgaaacagacaaactcaaactgagggacataccacacagtaactagccttgacatctttaaaggtgccaagatcatgaaagtcaaagactgaggaagtattccagaatgaaggagaccaaagggaaatgaaaaataaaggcaatgtatgattctgaattacatccttttgctataaaggatattattaagacaaattggtgaaatgtcagtggggtctgaggattaattgttagtaatgtatcagtgttaatttcctggttttgatggttatagtcatgtcggagaatgttcttgattgttgattgtaagaagtgcacagtcgagtatttgaggatgatggggtattaggttggcagtttgctgtcaaatgattcaggtaaaaatttttttactctcaacttttctgtaaatttagattgtttcacacttttaaaaatatggtatatcttggttaccctctgtatgccaaacactgggcaggtactaaaaatagaaaagtagagtaacatgagtccttacatcattcttgatgatacctgagtctaatggagggtacagatatgtaagtgaataattacagtgcagtctgatctgggttatactatgaatatatacaaagtactataggaaataaattatgacaaatgaactaggtttatttttttgacaagttttttggaatgacatttaggtagggtaatgtagaagaaaataagggcatgaatcggaaaaatgatagattaattgtcaagttttagagtagtgaaaaaatcatccctttaaaaagagatgcagcatagtataacataaagaaaccatatttaagtcagaagaactgtttaggacttggttttaccatgcgttagcgctggtgatcttgagaagtctagctaatttatttgaattttagttttgactttttaataaagttcctggctctcaaagctcatagattattgttaatatttgtactgattccttatacctaattgtagtgacttatacctaattgtagtgactgtttaacctgtataattaatttaagatgaattggtagagagcttgtagtgacagttgaataaatgtaaacctctgcttataatgctgtttgtagtagaacatattgtaattgttcattgctgaatgtaatgctccatttacttcattgctttactgttgtagtctttatcattttgtttttctgtttatagatctgttgggagaacgttttgcacaatggatggtcgtggaagcccagttcacattcatccttcctcagcagtaagtacttcatttttaataaagggaagaaatttgtaaagttgtagaaataagtaatatacaaatgtcttctacttttcactttggagttaaatttacatatatctatattacatagatctataagggtattggttggcctgtgcctcctgtttgaagaagataggaattaattgagaaggattyggactatttggttggtttaatgtggaatagggcaggttattgagttaccatcattaaaagaaatgttttgtatagcttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaagggtgagtaaatcatttgttctactcttaaccactatgccatactgcttcccagtagtacttcactatttttgtttataaaaatgttgtgacccacctgggcaatgtggtgagatcccatctctagcaaaataaaaataaaaattagccaggcatgttggtgtgcacctgtagtcccagtgacttgggaggctgatgcaggaggatcgcttgaacccaggagtttgaggctgcagtgaactgtgatttcaccagtgcactccagcctgggggtgacagagtgagacactatctctaaaaaaaaaaaagtgatgatttatgcattattaactcagaatcccctttgtttccaaggggctttttctttctttctttctttttctttcttctttgagacggagttttgctcttattgcccaggctggagtgtaatggtgtgattttggctcactgcagcctctgcctcccggttcaagctattctcctgcctcagcctcctgagtagctggattacaggcatgcaccaccacgcctggctaagtttgtatatccaaggggctttttctatgaaataattaggaccctggttgggaggcataaatagttgtggtactgaaataggacagaaagtttttcagctcacatacacagaaaacttcttagtaaagctttttgaggctgaatgatgaagcatattgtattttctttatttgacatcactgcaaaatggaatggtgaagagttttgccgaataaatcatagaaaaatctttagaaatgttagccactagggaggccaggcatggtggctcacgcctgtaatcccagcactttgggagaccaaggcgggcggatcacgaggtcaggagatcgagaccatcctggctaacacggtgaaaccccgtctctactaaatatacaaaaaactagctgggtgtggtggcgggcgcctgtagtcccagctactcgggaggctgaggcaggagaatggcgtgaacccaggaggcagagcttgcagtgagccgagattgcgccactgcactccagcctgggcgacagagtgagactccgtctcaaaaaaaaaaaaaaaaagaaaagaaatcttagccactaggtgttctattacagtgtaataacactgccacatgcttgaattagggtcagtttttctgactcattggccttggtgctcttaattttgtaaccatagactacattgcttttgaaagggcaaaatttaatttttctctttattgtttttactttgttaacactgaaaaatcagggcttctctttctcttaacatttctagtactgaatctcaaagctaagttttattggattaatttgtaatgttttcagatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcmccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaagacagtataatgtgtgtttttagatattttgtgtaaaaattaagaatctaaattttttatcggtaactcttctagttatttcctttggaatctagttttatgttcaataatagaaacttgaaatctttatcaaaaatcacaaggacccaaattcatgtatttgtccctaaagtaaggtgagtgatgatggtttctctaaacctttccagtgttttaatttgttaatttttttttttttttttttgagacggagtctcactttgtcgcccaggctggagtacggtggcatgatcttggctcactgcaagctccgcctcccaggttcacgccattctcctgcctcagcctcccgagtagctgggactacaggcatccaccactatgcctggctaattttttgtattttttagtagagacggggtttcaccgtgttagccaggatggtcttgatctcctgacctcatgatgcgcccgcctctgcctcccagagtgctgggattacaggcgtgagtcaccgcgcctggcctaatttgttcatttttatctttagtgctctagacactgttattagcacatattaatcatttagttctgtcagtttctcttctcaggtgtattgtataagggcatatcctcagatgtggtgggagtgtgtggattcttggaatgagagctcttctagtttagtaaatattaagcatatattctgaatctacacctcacactcaaattatatctgttgtttcagtaatgtcctttatggcatttttctgtagttcaagatttagtctaggatcacgtattgtatttagtctcttaatctggaaaaagtcctcagtccttgtctttcacaacattaacattttaaaataatataagctagttattttatagaatgttctcaatttgggtttctccaatgtttcttcatggttatgcatttttaactggaatactgcataagtaatagtgtcatggtatcacgtctggaggtacatggcattttccccttgctggtgttattaatgttaattacttattagggtgctttttaaattatatcaacctggttatccttataattcataaataatttgagggagagatactttgacattatataaaatatctcgttcctcataaaatatgacattttgtatttaccatcaattgatgattcttgcctgaatccattttattcttatggctgcaaaatggtgatttttttttctaattcttttctatatttgttggtattatattgtaaggaagagttttccttgaaggatgaatgtctgataaacgggtgggtgctaagaagagcatggatcaagacagagaagtatttatagaaagcccagggggtgtttgagatggtggcaaacagttgagtttacttggtgcatagaatatatataggagagtaggtggctcaaactgttaaggtcagattacagaaggctttgtaaaccaatctatagaatttggaattattttatggatttgttagaagggaaggacatcattacagttttgggataattgtgatagtgttattgataaaaaatttctgtatctcagtttgcattgagaggactgtgagagcagtagtatcaagggaatgctggatctagttaaggsaagaacatggaagcagccttgcaggaaaggtggsttttatggaggagtttgttcttagaagaatgggaatacaccttcaagttactaaatgaaacaaaacagaatcaaaaacaaatttttttttgagacggagttttgctcttgttgcccaggctggagtacaatggtgcgatctcggctcaccacaacctcggcctgccgggttcaagcagttctcctgcctcggcctcccgagtagctgggattacaggtgcgtaccaccacgcctggctaatttttttgtgtttttagtagagacggggtttcaccaggctggtcttgaactcctgacctcgtgatctgcccacctcggcctcccaaagtgttgggattacagacatgagccactgcatccagctgacaaatgttataatagaaaaatgggcaaaggacatggtcggtccttttataaaaggggaaacaggaggaagggtcagtaaataaaagacaatgaacctaacttgtaattagggagacggcattcatttccatcagattagcaataattaatactcctgaaaagtgttggtggtgaagaataaattgcttttatttaattaattaatttttcatacagttctgttgcccaggctggagtacagcatgatcatggctcactacttctttgatctaggctcaagcagtcctcccaccttagtctcctgagtagctgagagtacaggtgtgtgccaacacacccgactggttgttttaaaattcattttttgtatatatggggtgtcactatgttgcttaggctgggtctcgaactcctgggctcaaatgatcctcttgccttggcctaccaaaatcctgggattacagacgtgagccaccatgcccaggccagctcttattttagagaacattttggcaatatctagtaaagttgaagctgtgtacaacctgatacctagtaagtccacctctagacgtaggtggtctttgactagcgtatcacatctggaggtacatggcatttgccgcttattggtgatactagttttgtttacttagggtggacccagtaagtccacatttagacttaggggtttctctagactaggaactctcagactatatacaatattctgtgcctcataaaattggactcctatagatttagcgttaattgctgatgataaatacattaaaaatgttaaatacagcattcattacaatgtgaaatacaccattgttgctaatagaaatctgaaaacagcacatatatatatagctatatcagtagggaaaaggtttaataaattgtgatatgttcttactgttgaatcctacagcagtgaaagtgatttctgagattcctgatgtgtactcctatttagcagaacagatgaaccagttcatattccaaccagcaatatatgaaaatgccagtcttactacacctcatagttcctcagtcttctaattattgacaaaaaggtgcctcattatcttaatttacatatttagatatttaatgctttttccatgtgttcaaactgtagggaataataaaattatctgatttgaatttgataagccagatagtaaatattttaggctttctggacatgtaatttctgttgcagctactctgatgttgtagtatgaaagcaacaacagacagtacatgaatgaatatcactttgttccaataaaactatggagaatgaaattcaaatttcacatgtcagcaaatacagtcagccccctgtatctgggggctcagtatctggggttccacaaccacagattcaaccaaccacagatttcaaatattccaaagaaaatccaataaaaataatacaataatgaaagataaagaaaaaaagagtataacaactatttacattgtattagatattataaataatctagatatgatgtaaagtatgcaggaaaatgtgcatatatgcagacactacccattttatatgagaaacttcagcatcaaccagattttggtatcctcagggggaagtcctggaaccaaaccccagctgatactaaggaatgactggattattgttttgatttcaggttttttttctttgagatggagtcttactctgtcgcccaggctggagcgcagtggcatgatctcggctcactgcaacctccgcctcccaggttcaaatgattctcccgcctcagtgtcctgagtagctgggattacaggcacgtgccaccacacccagctaatttttgtatttttagtagagatggggtttcccatgttggccaggctggtctcaaacttctgacctcaagtgatccgcctgccttggcctcccaaagtgctgggattacaggtgtgagccaccacgcccaccagtttcagttttttaccacttgtatttgaatctagaaaagctactttttaatattcccattctaacttaaatgatcacttcatttgcaagaagaggtcttaatgaaatgtcagatttttctggcttttactttttcttcatagcagagttgatgagactaaacataatatcaaggaatcaataaatttaaatagtaatctttaatcacccaaagatttttaaagtaatccttattacttgttagctgttcctttaaacttaatacatgaataatacaaaattcccttgtgaagctgttaaagatttttcaaagaaaatgattagtcacagctgggcatggtagctcacacctgtaatcccagcactttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaatcgcttgaacccatgaggtggaggttgcagtgagccgagatcgcaccactgcactccagcttgggcaacggagcaagactctgtctcagaaaaaaacgacaatgattagtcacattctttgtccagataaaatccacatatttttcccacctattaatattattacttggttctcagctaaaatacaggaaatgagatgagtgaacccaaaatacagcctagcacccagtttggtgctttgtatatgggaggtatttataaatgattgtgccaactccagatgcgattactaacaacataaagtagcctaggcttcaaattaaatgggtcatgtaatcaataaatgctttaatagctggagaagtaaggtaaattgaatttttttttttttttgagacagagcctcactctgttgcccaagctggagtgcaatgacgccatcttggctcactgcaacttccgcctccccggttcaagcaattctcctggcttagcctcctgagtagctgggactacaggcgcccgccatcacacccagctaatttttgtatttttagcagaggcggggtttcaccgtgttggccaggatggtcttgaactcctgacctcaagtgatccacccacctcggcttcccaaagtgctgggattataggcgtgaggcaccgtgccttgccgataaatggattttaagctgagtctttgagggaagagtaggacctgcactgaaacaaaaagacaatttgtggggttggggagaggaaccagatgtaaacaatggaaaggttttggtgtcactttgagaaggattttttggaagggttttgcaatgtccattctgtatcttgggttaacactagtaagtcaaatggagaataatttgagtgtcactcattcctacagatagaaaaattttaaagtagcttgggccgggattttccttttatcatgtgccattgtgtacgtgtctgctacttcatttagttccttttttaaaaatggaatttttatcacttctgtgcaaaggttaaatttttttaataaattaataatggaatgtttaagccttcctcagtaatgagtataatcttatctctccatctgatctgatgggtcaactatatagtaactaaaatagactgtaacagctgtcttcatcattagtttttattttcaccatgcatgtagaatgctttatattgtagtcccttattatctgaggtttcattttctgatgtttcagttacctgtgttcaactatgtccaaaaataggtaactacaatgatattttgagagaccacattcacatataacttttattatagtacattgttataattgtcctattttcattgttaatatcktactgtgcctaatttataagttaaactttatcataggtatatatgtatagaaaaaacatagtgtatactgtatggggttcagtattagctgtggtttcaggcatcctctgtagaggtcttggaatatatcccttgtggataatggaggactacatatttgactggttggtggagttaacctaaggagaccttttcatgactctttaaacttttaggtttaaaggttgactcggaaaagaaaaacaatttatatcaataaatctaaggtaggcwtatatgaatgctgcatacttttcatcactgcagtgttgtggaatgaaaagtaattgtatggattttatactatacaacattaaactcatagttatttggaatatgagcaaccaggaaaagaaaataaccaggtattttgtttgatttacatagtaatctacttttagtagtcatgacaggatgaggtatggcattttaaaaaaagtaattcctagtattgcctaggtttggtactactcagattaggttacatttgcaggagtactatacaacaactgttcactttgatgaatctgaggcctttaaggttcagaactgctttccctatatcaatttttttttttcaaaaaagsctttacaaaataatttaacattgagtatttaattttacattgcaggtactggaaaatatttgttgaagaaattaattattccttaaaactttattattgagttaaccaaaactttaccaaatctcagtccttagctattctgttgcgaagaagtgagagtttactaccattaacaaggctgcagatgtacactgctactggcagaactatccctagagtggcaaaactctacatttcccaagggaacatatctgtgggtcatgttttgctttggagacagtagtaactctaggaggtgaacacagaacgttctacatatttagaaatagaaaaaagaaatagcccttaacaattaatcccacactctcaccctcattacctcttcattctatagatgctctcaagcttcttgtgacttttgttgcaagatgttgtgacatggcatctgactccctattgatcagcagggttaaaatcctcctgggttttcctatccacaatgttctgtgaattgctatatttaaactagcttttttttttgagacggaatcttgctctgttcccaggctggagtgcagtggcacactgtagagtggcaaatgaagacatatttatctgatcctctgatatgaaatcccctattaataaacacctttcttaaaagtgctatataaaagtatgcttataataggaatgtttcctttaatttgtctagaattgaaagggaaataggcagggggsttcaaaaaacaaaagggaaattgaaggcatccagaaacttattttatttttgagaccgagtctcgctctgtcacccaggctggagtgcaatggtgtgatctcggctcactgcaacctccacctcccaagttcaagcgattctcctgcctcagcctcccaagtagctgggatgacaggcacctgccacggtgcctggctaatttttgtatatttagtagaggtgggatttcaccatgttggccaggctggtctcaaactcctgacctcaggtaatccgcccgcctcggcctcccaaagtgctgggattacaggctgagccaccatgtcctgcctaaaccaacttttgtgaaatggctttttaaggtaatgtcatgaaccacttcattcctctgccagggtcttatttaacccttcaaaaacatgggtgggccctatataatgtgacttcattctacattggatccccacaaagctagtcttggcttttcacttggaacatgcccaatgctgatacaaagtaaagattcactatagatcttattgctatccatcgtacgttataaaacttgtctaaatatttaaaggtttaaaacaagcctgcgcagtggatgtcaagagtaaagtacgtttcatagtaaaattaaaatgccattaaaattttgttcttgtggggctgggtgtggtggctcatgcctgtaatcccagcacttgaggaggctgaggcaggcagatcacctgaggtcaggagttcaagaccagcctacccaacatggtgaaacccctgtctctactaaaaatacaaaaataagccaggcatggtggctggtgcctgtaatcccagctcctcgggaggctgaggcaggagaattgcctgaacccaggaggcggaggttgtggtgggccgagatcacaccattgcagtctggcctgggcgacaagagcaagactccgtctcaaaaaaaaaaaattgttcttgctttgtaaatgctgctttcttttcttcattttggagcggggagccttgccgatagtcagtgacttgtacatttgtttactggcatttgataggctgctccttatcttgcatgaaaaaataaagacctagccagtctaatcctgctgggattcatatcagtggccccagggggttgagatgcttcaaagctactgtttaaatggcaaaaccaagtatcttacttggataatactaaagtatgtcctttatggctttattggaatctgaattgtaaacatttggtacagtggattaaagttctgctttaaaattaatttctgagtatgtgagatatgccttttctttgtgacttttgcagtgcagtgaattcaggctgtttttaaaaggtcaagtttttaaaaggcaggggcattagtgctagggctgcttgaagatgaacagctaatggagaaatcctacagtgaaaggggttgtttttttttttgttttttgtttgtgttttgaggtgtcattctattgagtgtttatatatatatatatatatatatatatatatgtatatatctccatcctaattgttggcataacattaaaattagtgacacaacacaggtttcttgtataggttttcagaaactagcagtcctcaaaataacagaccaagcaatgtagtttttgctaatggcacttgctgtgactcatgatagtctactgttgatgagcattccaactaaaatagctttcacttcaccattgattaacatggctaccttgctaaaacattttctgaaaccaaaagctagagtgatcattcatagcattgtcttattaaaagactatgtcatactgtatcgtagaaaaagccattctgggtagtaggatttgcttcctggtctattaggttatctgttctcccttctaacttgaggtaatgtctgaaaacagtgccattcaggtattgcttaggtaactaaaccagtgaaaccagtgaaactgcctttatactgttaccaagaacagcagactcccattaaaaaaaaaaaaaaactcttattaccctactcaaattattcatctttaaaaaggcatagggtttttttttaatgtttatcatcttgactttttttttctcttgaaaatttttggattaatttgaagatcatttcaaaatgacccaggatatcacgatctatttttcctcttcctaaattatttctcaaaacagtgtaatttctatgtgtgatgacgtagcagtcactaacaacctcagcgcactttttggttagatattccactccaaatagctaaaatcaactgcttttgggattctaaatgtacttaaagttacagggtctgtatgaaaatgccagacactaattaaattttggtggcccattcatgatacggctcttttatctccggattctgagattgaaaaggtgacttgatcaagctattgaattactgtaataaaacaattactcccttagaattttaatttagaatttgtctacttccaaaaagggtttaaagcagttattactagactggcattaggttatttcaaatgttgcggaacagaggatcttcgtgtatttagcttaacaatacaaaaagaaattttgcaagcataaatattcactcttacaacatggtggcaaggcttttctttgcagaacaatctttgccctcttacctgccagactcttctctcatgctcagtatgtgagacagttaagtaaagggaaaaacactaaaagcaactaaaatgattggcaaacttctcactgtaacctaaactgcttagcatacaaaattatcgtctacccaatagggttttatgtcctttaactgaaaaggacactaaaaataattattgtggacttgagcttttctctttcggcggggcggggggtggggggggagaatcacctctcttacaaagataaaaggcacagaactaacgtctttcatcctttattgtattggtgcgattatgaaatattattatggcttatactttagcaagaaagtaccaggaaggttattattaatcgacaatgaatgccgttgataccttcatgctctttgaagacaggatgctccggctttgaagcgctacatttctacattgctaacctacaggaacctatgttgaggtggtcccaccgaaatacacggctaatagttcatctctttcctccaggaaccttcaggtttttttttgtttgttttttttttgagacggagtctcgctctgtcgcccaggttggagtgcagtggcgcgatggaaccttcgggttttactaagcatccttaccctaattatctaaatctttgagacgtaaattatttgatgtggctaaaaatcctcctgctagaatttaggtccaatcctttaatgttcggatactcaaattctttaacgaaactgatcactgagctaggccgacacaagtccgccaaaatgtccgcagaaacgttaagaaaagctgtcataaggccagcttgaaagacatcataaaaggccttcgctgtcctttgagttaattatctaacacccgaagagagtgccagttctagttagaatccgcgcgtcaggttctccaacagtcagaagggcttgtgtgagggcagggaagattttaaaccccgtttcaggccccctccctaggctgtaggaaaccacccactctgaagcccggcgggggaggagtgctgcagccagctgccgagggagcgctctgcggcgaggccgtttccctgagtcacggagagggcgggaggctgcgcccgtctgcccccgccacgtcctcctgtgaggggctcagtcgaaacaggcagcggtcgcagggaaacgaagcggcacccgtcatgcctcaaggtggcccaaaagcctcttcactcccaggagacgccgcatttccttaaaacgagctctccatttctggcagcaatcagccgacccttccccatcagtatcacgtgcacctggaagtacgtgggtgggacctaaagcgcccacggaagtgacgtcggtcgccccgagtcgcatgatgtggcaaaatgaaaaaaaaaaagtggggggagaaagagaagactggcgaaagtgatgagtctaaaaaagtagtccctccggttcctctgtttccccccatgtggcgtcaggaagcgaggcaccgggcgcactgcgccccgaattcctgcgcccgccgcgcgcggcgctccgtggaggggtacataaggcggagggggtgaggcgactgggcggagttctgtcgccgggatccttccgctgggctcagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccaggtgcggccgggcccgggctggtgagggctgtggagaaggtggtaggaaggatggaagacgctggagtctgggcccgagcagtatcggagctggaggggcgggggggttgtcggtgattggggtaggtggaggagggggcactatcttggaaagcttaaaatattaaatgatgtggggcttggatggaaaggacaggagttggggtgcaaagagctgcaaggaccaggcctggatccaaaggcctctcgatcttgcttcctggatggccagaactgcgcgtacaaactctctccccattttattcatttcattcatttgggtaggggagtgggagggggattctcccttgtttctaccagagcaaggattcttatcccctgggccagtgcggggctgtcaccttccattgctctcctctttccctcatcgtgtctgcacccaggagttgtggggcgggtgggttggggaggagcaaccttttttttccctccctctgcggctctcaactgagaaaggcaccttctccggtggtgggggttgggggtggtggtgaggcggtggcttttctcttgccttccctgaggcagtagggacagaaggtcactgaaagaacggaacgagggtagaatgggagaacgcatttcttagagctatgtcaatctcagagtgtgtgcggtcaaactccctaaggaaactcgcctccccttccccctttttttatttctctggggatgttgtggctcttaacccctctttggttctggaaggtaggaaagagtgatacagaggttatcttttagtcttctcgagtagtagcaggtagttttgaatatcttcttcaggatcgcatggaattgaacagagccctggggacagcacagctgctctgagacctgcagggctatttggtctgtgactggcttccctttagtaagttctagagttcttccccatggttccttatcctggaggcaacatattgttatctggcaacatgccagtggcgggcctaggcaggtgaccattggaaggcttcactgaattaaacctcttcagagcttttgattttcctgtgtcaccaatcctgttttttactgtagcttaaataatttattcctattaatttgctttcttcccaaatatccccttaaagaaacctgcctcagctcagtcgtctgaagggctaattccataatgacagggaatgcagtggtttgacatgacactgatatcagtgacctattagacactttaccattgaagaccatttttatttacatttccccattggcatagcatacataaaggattcttgttaataaaaggttttaacattcaggctataagtaacataatttcatatttctttgcaagtattaccatgtttgcactagcaaggacttattttcctttaaggcttgaaatgtaaagaataataaatttttacccataaaatgagttaaataatgcactttcctcagtcatctataattttcaaataactcatctgaagtaatggaatataccttggcaataaaaacacttttacagagggttaaaaatgttaaataacaaaatggacatttttttttgatcaatccaagtttagttgctgtggttgcttttgttaaagtggggtggcaaatgaatgtggagagttgaggggtgctgttcttaagtgtgaggggaaaacgcgggcttattttcatattaaactgcatctgaaatatctttctgcagacaaatgtttataaaccacacagagaatcaagtacagctgctctttattttccacggcagatgtgtagctcactactaaatcttgtggtggttggagtaatagcttttcatttcttttaaagaggagacaagaattgttaaatgatcccaaagattcgaacccaaccttgtcacttattaaagacaaatttaatacatgtctgttttgtaactggatcaaagtttctgcagatgcttgaatgaagccattttcttctcaaataatttgaagattttgaatataaagcgatttgcaaattgaaaaattcagtcctctgtgttttggattgctatgtcatgcctaaacttaagcttgcttagctaatatgactgtgctccagttgattaattgtggagcccaaataactacagcctctttcatgataatatatctcctaacttcatatcattatctcctccctttttaaaaattaataagcattttgtttttttgaggagacagggtttttgctggaggtcagtggcaccatcacagctcactgcagccttgacctactgggctcaagccatcctcccacctcagcatcctgagtagctgggactacagccatgagccaccacacctggctaatttttgtattttttgtagagatggagtttcatgttgcccaggctagtctcgaatgcctgggctcaagcaatcctttgccttggcctcccaaagtgctgggataataggtgtgaaccaccgagcccaactaataaggattattttaattggcatctttggtctttgacctctgagcttctaccagtttgctaagtagcagaaaactttctgaaacacgtaggataaaaactggaaacaagaaatggggaacttaagtgtgagtgtagagttaccttgtgaaactgtaaatgaacttatttttataccctttaactacattgtccaactgaaggatct

SEQ ID NO: 12465 - DNA, 20308 bp, Homo sapiens
agccacccccgtcacgctccctgctgtcccccttcctagccaggctctgtttcctgttttcaggcttcatatcctgaacgctgggatcccccaggacattccctggcccccaggccccaggtcccaggccccagggctgagctgtgggcaggccccacctggtgagttacttggggactgaggatggataggaggaagcacagaggaggctagaggctgagattcgccctgcaggaagtgtgatggggcatgcggctgggctgcactggaggggtgggtagacgctggcactgggaggataggtgggccagcatcctggatgaaaggctggagatttggctgctggagggttaaaggtgaaggaggaacatgggcggctgagatggggttaatttaggagcctagacctggagggaaggaggggctgcccttcttggggctgagagtggctttggggaccctgggagtgtgtgggtgtggggtgtggggtagggccaggcagcaacattccagagatactcaggggggtaaggggccagcaaccgcgacctttctctcgtctcagaaaaattataagcagatgtgggcgcctcggggaggcgtagagcagggagccagagcaagttttgggaacacggaatgcagaccctgaagccggctgcggggatgggcactgcggtaactcatcctctcctgagctcaggagctgaggcagcagagccgtctgaagtgctgggagccaggggtggtggggatggagaggaccccatttccgaatggctgacagggcagtctgagggaggcgggagcttttccttaaatgcaaggccaggttggtgacctcttcaggcgatggcacctagagttgggtgttgtggtgtgctggctaaggtgtcacaactgactctgggagggagactggccttgggttttagtgtttgctagtttctctggtgtcaataaccccccatgcctgatttcaagctactcacgtgacatcactgaacatgttgctaggaagagatgcatacaattggctctctgggcccgtatgaggtggttccagcacaccactggttgggaggtcacctggacccagccccactcccaccatatagagcaggaaacccctgacagcgtttcatcaggctggttttggcttctgcctgcatatgtccagtgacagggaactcaccacctgaggtagccgattctattcctgagccgctctgactgttggaaagttcttcctctgactgagcccaaggctgagtccctcatcacttcccctcactggttccagtctcacaccttggtacaaatatcaaagtgccctgggtagggcctgggctgggggctggggattcagagatgaaacgcactgggtccctgcctctggaggtcatggtcagggagcaggcactggaacagtggggtgggggtgaatgatactgggacccccagaaggaatgagtgggatcatctgccaatgagcatcaggaagtggaggagggaaggggtggcacctgaactagaccttgaaagatgggaactccaggtgaagaatgagacgtgagggtgtctaagcaaactatgagcaaagaccggaggcgtggaagtgactgcagttcaggagtgaggtgtaggggagctggagctcagagcaaggggccagaggacacggggccgcagtctggtctcttctgcatgcccacggctcagatctctgcagacaggtcctccaggctgctggctgcagcgccactgcccactctgcgccggtcttgctgcaggcctctgcaatgtcaccgcctctgtgtcccctccttctcctggctgtgggcctgcggctggctggaactctcaaccccagtgatcccaatacctgcagcttctgggaaaggtgagagggcccctgctgcaccttgagggcaccaagccctagctcccgattgtccctattgtccctactggggtccttttcttggtccttccttaatctccttccttctctctagtctctcccctcccgcctatttctctgtttctgctctctctactcctctctatgggttgcctttgactccagccccatttctgaccttgtctcagtctctgaaccatcctttctctttccccgtcccttagttcctgtgggaggccaactttggaacagagcgcagagtgggagccattcgttgtggagcaagcagaggggctggcccagggggagcaaaggaaacagggcggggagaaaagacccagggcagaatatagccggaaatacttcagcccatcgccgccagctgggcccaggagtcagttctcactcaccctttccatacagggaggagagggcagggagagaaaaatggaaggctccggtccaatagagtgggaagggcgctctgatggagggtatcccaggaaccttccagttctgggagaagcctccagacttgagaggtgggacaggatgggggtcccatcctaggctacgagagcagccccagcgttgggctgtggattccccactgtggccaagccctcatggccattttcccgttgtggccgctcaggcctcctcctgccctcggccctgaccctgttccctgtcttgcagcttcactaccaccaccaaggagtcccactcccgccccttcagcctgctcccctcagagccctgcgagcggccctgggagggcccccatacttgcccccagcccacgtgagtgctcctcatcctccatgggtggatgggctacctgagtcgctgcctcagcctggcccctggccctctgtacctgttcacttctcagaaactcagaggaaactcctggcttctagggattcattctgcatggtctgtgtcgggtacgtgtgtatgggatgtatatgtgaatgcgtgtatgtgtgtttagggtacgcatgcatgttacagtatatgcctgtggggttggggggggggcaagaagggaatgctctttctttttttaatagacaaggtctcgctctgtcacccaggctggagtgcagtggcgagatcgtagtgcactgcaacctcaaacagggaatgcgctttctatgcgccctcagcccagagtgttgagtggtgccccttccctggcctccccctggccacactgtggtgagtgcggacagcagggagggctgaaggccaccttcctggactccgcagggttgtataccggaccgtgtaccgtcaggtggtgaagacggaccaccgccagcgcctgcagtgctgccatggcttctatgagagcagggggttctgtgtccgtgagtccagggttgggttagggagcggggtggggcaatggaatgcggggagcttagcctactcttctgagtccctcccggcccccgctagaatggggttactcctctgcccttttgggttcccccctcctctcctctccctggccttgtccccaggatgcggatcagcacttccctctccatcaccacttcacacccctgtctccagccggccccatgtgtctcccaccccatctctccatgtccctcaacagtgtctctgcatcgctgtctgccctagagctcttgttctgtctttgggctgtctctgtctctctgtcactgtgtgtctcaggacttggtgtctgggtctgcctctgtctcttcctctccctgactctctgttgctattggtctctgacttgtcactatccagtctctcctgcccactgcacccccctcccagcaccctgtaatgactggagcctgtcttcctcttcctcccacttccctcagccactgcccatcacgagcctctgcaaacactgctctccagagaaccccgaccaccacctgccctctctctggacagtgtccatgttcagtccccttttgaggatctcccccaaagcattttcccaacaaggtgctcagacaatttcacaaaaaggaacaggggaacccagaacactggcatcttgctaagttctccccctgagttgctgcccctcagtctttatcttagaggcagaattggggcttggagaacttcaggtccctggttttggaagaaggtggggttaggctttgcaggataaaagctgggtaggggcaggggtggacacatctcaccacacccatctctgtcccagcgctctgtgcccaggagtgtgtccatggccgttgtgtggcacccaatcagtgccaatgtgtgccaggctggcggggcgacgactgttccagtggtgagtggctactgaccccagggagtggcctcttgtgccttcagggccacaggaccctcaggtacaccctccctaccagggcacaggggcttaggaccccagggcgattacccgccagagccccattgctgccatctgccttttctggagatgtggaagacagggtgggcctgtgggggctgggagacagaggctgggagacagagacggggaggctggggatggactagacccctggtgacccccttcccgcctccttatcccacagagtgtgccccaggaatgtgggggccacagtgtgacaagccctgcagctgcggcaacaacagctcgtgtgatcccaagagtggggtatgttcttgcccttctggtctgcagcccccgaactgccttcagccctgtacccctggctactatggccctgcctgccagttccgctgccagtgccatggggcaccctgcgatccccagactggagcctgcttctgccccgcagagagaactgggcccaggtatgtaatggggggaacgacactttaacaagatcgcagacacaaggccacacagatctatgtggggaaatgaggtgactcagacagggccccaagtgtggggatgatgtggaggccaagatcctggtcccagtggatcctattcctcacgagtggagtgaccttgagcaaatcattgactcgttgtgggcttgtttcctgtctgtaaaacgggaatagtattgtctacatggcagggtggctgtgaagataacatgaggtagcacgtgtgtgaaggcatgctgcaaagtgaggctgggacaaggacccagagaaccctgttgcaaggcagggtgcagggggagctggggagtcccgggagggagaaggtagacctaggtggaaatcaagatcacgctttgtggaggcgctcgtggagttgagcctactacagtagcacagatgttccccgagagtgaacagaccaagccaaggtgaggaggtgggggcgcccgagaggcagacatgccacccgtggctctttgctcacccccacctgccggtgccagggtgtccctgccatttccagtcctggaaacctttgctttctgactcgacagtccccagcaggaaagagcaagtgtgaatcactaagtcctgaggtgggggttgtgggggcagtccttggaggcaagagaggaagcagttattgcttgtttgcacattgactccacccactctgtcctgcagctgtgacgtgtcctgttcccagggcacttctggcttcttctgccccagcacccatccttgccaaaatggaggtgtcttccaaaccccacagggctcctgcagctgcccccctggctggatggtatggagggtggggcctgtgggcatggggtgtgggtctggggagaattctgtgggtggtgctaagcagggctccaaggtgagtgaggggggtgagctctgtggttatgggggtgtcaaggggtcctgtggccttggggaggaggctgggtgcctggggccctgttgacctcttatccccacagggcaccatctgctccctgccctgcccagagggctttcacggacccaactgctcccaggaatgtcgctgccacaacggcggcctctgtgaccgattcactgggcagtgccgctgcgctccgggttacactggggatcggtgagtggcgtggggcgggcgggagacgggagggaggaggtggggcgccgccaggctcactcagctaggtgcccaggtgccgggaggagtgcccggtgggccgctttgggcaggactgtgctgagacgtgcgactgcgccccggacgcccgttgcttcccggccaacggcgcatgtctgtgcgaacacggcttcactggggaccgctgcacggatcgcctctgccccgacggcttctacggtctcagctgccaggccccctgcacctgcgaccgggagcacagcctcaggtgggccgcgggacatgtggtcaaaggatcaggaggccaatggggaggtcttcctggccgaagtcaccacagagccagggccatatccaagggggacaggtgtcacagaaggggaaagggagggacctcaggggccgggaggggcctggggtaccgctacttgccccaacccagttttcagaatagcgcggagcctccctagtgacccccttaccccagcgatgtgcgaatcccactgaccacgcggaggggtcgggaagctgccctgcccctgcccagctcagaccrcgccacgcccccgcytctgcccccagctgccacccgatgaacggggagtgctcctgcctgccgggctgggcgggcctccactgcaacgagagctgcccgcaggacacgcaygggccagggtgccaggagcactgtctctgcctgcacggtggcgtctgccaggctaccagcggcctctgtcagtgcgcgccgggttacacggtgaggcgcgcccggctgcaaggaagcgaggcaggtggagaggccaaggaatgggccgcccctctcacccgctcaccctctttcagggccctcactgtgctagtctttgtcctccygacacctacggtgtcaactgttctgcacgctgctcatgtgaaaatgccatcgcctgctcacccatcgacggcgagtgcgtctgcaaggaaggtaatagggtggagtttcccagagagaagacttgggggatggccaagggaagaagggaragtccaagagtatgggtgggccaagggcaggggagcggctgcagggtaagggtggaggggcagcagctggacacagggaaagtatccaggctactttcttcctggaatatccactttgcttttcttcaaccacaaagatcctacctgtccttaaaggctgaggccaaaagccacctcactggcgaacgtccctcaccctcagtcatacggaaacacaattaccatgctgggaagggcctcacatctgccagagtgacacattggcaacctttaggctggactcggatacagttgtgctttgtttggctaacaagtctcccatcttcagtccccactactccctgttgtctggcacatcctctgtataagtcatttagttacctgatggggcccctgtaaacatttgggtttagtgccatcccctttattttgcagaaggcaccccagacccagaatggggtggtacctcactggaaggcagttagccttctgctccgcatcaaataactcataagcttttctcctgtatggtgccgtgaacaccccccacccaccccagctcatagcatagaatctggcccagccagctcccactgtgtgcttgctcaggaagggaaatgggtccccatacctacctaccaggcycctcctccaggttggcagcgtggtaactgctctgtgccctgcccaccyggaacctggggcttcagttgcaatgccagctgccagtgtgcccatgaggcagtctgcagcccccaaactggagcctgtacctgcacccctgggtggcatggggcccactgccagctgccctgtccggtgagtgctggacagcctgtctgcctgggggtggggagggcatggcgtcccccagctgactggcctacctgctccccactccttctccaagaaggggcagtttggagaaggttgtgccagtcgctgtgactgtgaccactctgatggctgtgaccctgttcatggacgctgtcagtgccaggctggctggatgggtgagcattctggggccccaggcctactrtggattgggggatgcatccataggaaatgtgtccagaagagccccctgraactgaagggggcccagccaggcacacccgactgctgtctcccacaggtgcccgctgccacctgtcctgccctgagggcttatggggagtcaactgtagcaacacctgcacctgcaagaatgggggcacctgtctccctgagaatggcaactgcgtgtgtgcacccggattccggggcccctcctgccagagatgtgaggctccctactgccccttccacctgccaccagcagggggcagtgtagtgtcagctgccagagcacccctccccccgcgcccgccgcccacctctcccaccttacccccggtctcttcctctgacccgtcttcagactagttactgcagtgggaaggtgggagggagacggtggggtaagggctgattgaggattggcctctgcccccaatcaccatgtacccctttcccccagcctgtcagcctggccgctatggcaaacgctgtgtgccctgcaagtgcgctaaccactccttctgccacccctcgaacgggacctgctactgcctggctggctggacaggccccgactgctcccagcgtatgtggtagcttgtgtgtctgagcatacgtgcatgctgagagggggtgctgaggacgggaggtctctgtcccccagctcctgggtataaaagcctctgggcccaccttgagtaaatatttactgggcaccacctacatgctgggtactgttctaggtgctaaggatgcagcagtgaacaggtcagggggaaaaattcctgcccttctgcatgggaagcctgggaagaacagtatttttatgggagcaggggaaatcataggcttagcttgggacattttctcttgatttctttttctttctttctttctttctttctttctttctttctttctttctttctttctttcctttctttctttcttttctttcttctttctttctttcctttctttcttttctttctttctttttctttctttctttcctttcttttctttcttctttctttctttcttttctttctttctttctttcctttctttctttcttttctttcttctttctttcttcttttctctccctccctctctctttctttcttttttttttttttgacacggaatctcactctgttgcccaggctagagtgcagtggcatgatctcagctccctgcaacctctgcctctggtttagttaattcttttgcctcagcctccccagtagctgggattacaggcacacaccaccacagcaggctaatttttgtatgtttagtagagacccctggggtttcatcatattggccaggctggtctcgaactcctgacctcaggtgatccatccgcctcaggtgatcttggcttcccaaagtgctgggattacaggtgtgagccactgcgcccagccctttttttcttttgcatttttcagtttatttttatttatatattaataaatacatgtatttctttattttatgagcctttcccccacaaaaatatattaagatcattgaaaagattagtccaaaaaagccaagtaaaacgagtttggaaagaggaaacaggctgttatgaagaagactgaatttcagcttaccagcaggcggggtaaagaaggaagtcatcttggtgaagagtttttccatagactctggttacaactactattagattattgctagtgttagacacacaaaaataatgccttaaacaggacagatgtttacttctctcttatgttaaaaacaaaacaaaaatccatccggggtagcttggaagcctttggttgtgtggcactgaatacactattttgaagtggctattagatagtcaagtgcagatgttgagtaggtagttggacacgtgggtctggagtttgggggagagatggggctggaaataatcatttgtgagtcattggttgcagatactgttcaaagctttggtgtgcccagggagaccaaagctgagctaaaggcttcagtgatgctgggggctgagagttcatccaggaaaagctgtacctgccccaccagacaggccccatgtctcccgtagcatgccctccaggacactggggagaaaactgtgcccagacctgccaatgtcaccatggtgggacctgccatccccaggatgggagctgtatctgccccctaggctggactggacaccactgcttagaaggtaccaacagaaggggaactccaggcccctgcctccaacttaacccttacccaaaaaaaggagactagagtttcctggcggctctgatgccggyctgcctccttggctgtctccccaggctgccctctggggacatttggtgctaactgctcccagccatgccagtgtggtcctggagaaaagtgccacccagagactggggcctgtgtatgtcccccagggcacagtggtgcaccttgcaggattggtgagttctttgccctctccttcccacccattgtccccagggaactgggacctaggcccctcatacagtccctacttccctcctgagcacctctcccatgcagcagagccaagatgccattctgagtgagcaccccattccacacaggaatccaggagccctttactgtgatgccgaccactccagtagcgtataactcgctgggtgcagtgattggcattgcagtgctggggtcccttgtggtagccctggtggcactgttcattggctatcggcactggcaaaaaggcaaggagcaccaccacctggctgtggcttacagcagcgggcgcctggacggctscgagtatgtcatgccaggtgagctggcacagggyctggggcacagatgagtggctggctcataggcacaagagtggatgctgggcatgacccaaasggaagatgaggagtggggaggagggaggaagggaggtcagggaggccaaagtactgatctccggggacaaaacagctctcttggactcctgcccatygctgagctcaccctgtgcttgtgtctgtcatgcagatgtccctccsagctacagtcactactactccaaccccagctaccacaccctgtcgcagtgctccccaaaccccccaccccctaacaaggtcagtgccgggggagggggtgcactgtggagggaagcgcacagaccagcttctctggaaagccctgtccttgcctcttgctctccctcctgcactgtcccctcttaggttccaggcccgctctttgccagcctgcagaamcctgagcggccaggtggggcccaaggrcatgataaccacaccaccctgcctgctgactggaagcaccgccgggagccccctccagggcctctggacaggggtaggtgccgggaggccagggtctctggcgcgggtggatgtgtgcagcccagatgccgcgtctgagtgtgtgtgtctggagacgggggctctgggccccatttctagaggaagtgtgagccgggggaggggacagagggctgattaccagttgcctcctcctcctcagggagcagccrcctggaccgaagctacagctatagctacagcaatggcccaggcccattctacrataaaggtatgggcacaggggcaacaagggaggtggctgagctggggctgaggaaccagtgcctccatgcggcctgacttctttcctctatccttagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatggtgagccctccctctccactggcaggagcagcagagaactgggacaagggaggcagaaaaacagaaggaacagagggagaagagaaggcatgatgtggcatcaagagtgaggcctttggggtcagcttygggctcaaatcaggcatgacggggaggcgacgtggcctctcagagcctgtgtcctcatctggagaacagtatggtgtacctwcttcgcagagctcaggatagaagtggggtcgtacagcatcagagtggtggagttggtacccagaaaagtagggagccaggcaggtgataaagtctcctcatatcctgggaggtgggcgggctgaggtggctttctccattggcagctgagaagctaagagagttttgcttggagccgcacggccagctgatagtaaactggtgtatgtatccaggccccatctgcttctctttgccttgaagaggctgaagaggagaggagygcagtgggagtggagggagtggggagagtggtgggaggagccactccctcttatcttgtcctcatgtttccagaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacgcttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgkgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaacgttgtgtgtgttctgactgctccaccgaccagccgttcccccaagtctttccctctcttagggcctccctattccctgagacacaacaatattgaaatgaggccaattaataaccctacaggggcctctaagtgttgaagtgaaaggaatagtcacacatctctcacttaaaatcagaagctagaaatgattaaacttagtggggaaggcatgttgaaagccaagacaggctgaaagctaggccttttgcactaaatagccaagttgtggatgcaaaggaaaagttcttgaaggaaattataagtgttactccagtgaaaacatgaataataagaaagtgaaacagctggccgggtgcggtgggtcacgcctgtaatcccagcactttggaaggccaaggcaggtggatcatgaggtcaggagtttgagaccagcctggccaacatggtgaaaccctgtctctactaaaaatacaaaaaattagccaggtgtggtggcgcgcacatgtaatctcacctactcaggaggctgaggcaggagaatcgtttgaacccgggaggcggagtttgccatgagcggagatcatgccattgcactccagcctgggtgatagagcaagactccattaaaaaaaaaaaaagtgaaacagccttgttgctgatatgaagaaacttttagtggtctggatagatcaaatcagccacaatatttccttaaaagccaaagcctaatctgcagcaagaccctaactctcttcagttttatgaaggctgagagaggtgatgaagctacagaaaatttagaagccagcagaggttggttcgtgaagtttaatgaaagaagtttaagaagccatctccataacataaaagtgcaagatgaaacagccagtgctgatgtagaagctgcagtaagttatccagaagatatagctaagacaacgatgaaggtggctcctctaaacaacagattttcaatgtagacaaaacagcctatattagaggaagatgccaatctaggactttcacagctagagagaagtcaatgtctggcttcagagcttcaaaggacaggtgttaggggctaatatagttggtaactttaagttgaagctaatgctcatttaccattccaaaaatcctcaggcccttaagaattatgttgattatttagtgtggcgtggtggcacatgcctgtagtcatagctacttgagaggctgaggtgggagtttcgcttaaggccagcagttagaaggctgtagtgaggccaggtgcggtggctcatgcctgtaatcccagcactttgggaggccaaggtgggcagatcacgaggtcaggagattgagaccatcctggccaacacggtgaaaccctgtctgtactaaaagtacaaaaaattagccgggtgtggtggcgggtgcctgtagtcccagctacctgggaggctgaggcagaagaatcaattgaacccaggaggaggagcttgcagtgagccaagattgcgccactgcactccagcctgggcgaaagtgtgaaactctgactcaaaaaaaaaaaaaaaaagaagaaggctgtagtgagctatgatcatcatcactggactccagccttggcgacagagcaagatcctgtctctaaaaagaaaaaaaaaaaaaaggccgggcatggtggcttacgcctataatcccagcactttgggaggctgagtggggaggatcacttgaggtcaggagttcgaaaccagcctggccaacatggtgaaaccccatctccactaaaaatacaaaaaaaattagccaagtgtggtggcgcgcacctgtagtcccagctactggagaggctgaggcaggagaactgcttgaacctggaaggcggaggttacagtgagccaagatcgtgccactgcactccagcctgggtgacaaagcacgaatctgtctcaaaatagataaataaatagaaaagaatgctaattttaccctgcctgtgtccctgtgctctggaaaaggaacaaagtctggatgatagcacatctgtttacagcatggtttactgaatattttaagcccactattgagatctactgctcagaaaaaagtattcctttaaaaatattattgctccttgacaatgcacctggagatgtacaaggagattaatgttgtttgcatggttgctaatacagtatccattctgcagcctgtggattgaggagtaatttcgactttcaagtctgattatttaagaaatacattttgtaaagcatgagttgccatacatagtgattcctctgatggatttgggcaaattcaattgaaaacctggataagattcaccattctaaatgccattaagaacatttgtgattcatgatgggaggaggtcaaaatattcatgctaacaggagtttggaagaagttgactccaaccctcatggatgacttggaggggctcaagacttcagtggaggaagtaactgcagatgtggtagaaatagcaagagaactagaattagaagtggagcctgaagatgaaactgaattgctgcaattcatgataaaagttgaatggatgaggagttgcttatggatgagcaaagaaagcagtttcatgagatggaatctactcttggtgaagacgctgtaagcattgttgaaatgacaagaaatgatttagaatattccataaacttggttgataaagcagtggcaggatttgaagaattgactccaattttgaaaaaaagttctacagtgggttaaatgctatcaaacagcattgcatgctattgagaaatcttttgtcaaaggatgtcaatcgatgtggcaaacttcactgttgtcttattttaagaaattgctacaggcaccgcaaccttcagcaaccaccaccctgatcagtcagccgccatcaacctcaaagcaaggcgctgcaccagtgaaaagattatgactcactaaaggctcagatgatagtaacatttttagcaataaagtatttttaaaattaaggtatgtgcattgggctgggcgctgtggctcatgcctgtaatcccagcactttgggaggccgaggtgagaggatcacttgaggtcaggagttcaagactagactggcaaacatggtgaaacttcgtctctactaaaaatacaaaaattagccagacatggtggtgtgcgtctgtaatcccagctactaaggaggctgaggcaggagaatcgctcgaacctgggaagcagaggttgcagtaagctgagatcataccaccgcactccagcctgggcgacagagtgagactccgtctcaaaaaaaaaaaaaaaaaagttatatgcatttctagacataatgctattgcacacttaacagactacagtatagtgtaaacgtaattttacaggcactgagaaaaacaaaagcggtgtgactcactttaatgccatattagctttattgcagtagtctggaacccaacccttagaattttgggggtatgcctttactcaaatggggcccaccagggcagaaccatcagggtctagagtaggagtcaggtgatgactttgaatcccaggtttgtaaggagtgtgattcaccttattaactcgttagaggattaactgagtccccagagacctccaggaggctaaacagatggaggtcgagaatataaacctagcaccacaccaactagatgggtttctctagacgcctttcaccaggtgctctctccttactggacagcggggtggactctggagagtggacctgcccccacctggattctccctagtatcctccgaccgcccactaccccactcccccaggctccgccccgatcccccaggcccagttccaggatgactttggattgcccgccctcgccctatccctgtccccgctcccgtcctaagatccactcgtttccttcgccatggctccgctcaggtcctaggtcaccctagcccttctctcttagcacaggctcggccagccctggccctctgggacccatcagctcctgcgatctctggccggcctcgccctgcctgctccgccgggcctggcccgcccctcgggttctggctccgccacccgccctcgtgggctctcccctcgccttgctctgccctgcggcgccccctgtcggccccgcgtgctctctgcggttgcccctttccctcgggcccgcccgcctcgcgcggttgtcttggagagggacgcgtaggctacgccaccgcggacgggtcggatccggtccctggacgcggaacagagatcccctgattcagccacccccagactgagccccgtagagtgcgttcttaccttcctgccccgacgaaggtcccagagacgctgcggacaacaccagcatgtcgagcgagcagagcgcgccgggggcctcacccagggccccgcgtccggggacccagaagtcttctggcgcggtgaccaaaaagggagagcgcgcggccaaagagaagccagcgaccgttctgcctcccgtgggggaggaggagcccaaaagccctggtacgctggcgccggggtttggggatcgggcttccaggctgcgtcttcccgggttcccactagctactcactgctccaaggttatggctgaactcatacatacctacgttgagttcctgaatctcggcttgatagatgtttcaattgaacttgatcttaaagaacccacactctggtttgggatggtgacaaataccaataagatgtgataagatatagaagagaggaaggcccagggggtgagggcatcaggggtgttgccaggaggtgcctttgaacagagtttacagatgttcattcattgattcaacaattactttccaaatgccagccatgaggccagatatgtcacggaggagaacgaggtggacacagtcctgcccccatggggtttacatcctctgggaaaagaaaatgagtagaatggtataagtagaggtatggccctttttgttgcaagtgatagaaccccaatcaaactaagcatgaaggggaaatgtatccgaagtcttcttgatacaaatctgccagcttcgtcatcacggggacaagaacttgctgtctctggaatcgaagtaaaacaacttgggaaaaagatctgatcatccagcattagccaggtactatctctttgtcagtgctggtggatggggagaaggaattataggagctggagaaacaacatcttctggaagggaagacaagacagtatacaatcccctacaggtacgaagccagttacattcaaaacacacacacacacacacacacacacacacacacacacacacacacacacagacatggctgctgtatagaatacagggtggaaggaggcaaacagatgagttaccggactatttcaacagcctagtctggggacagtgggagttgggatagggcagtgagaatggtgaggcttggttgagttaggctcctcagagaaacacttttgaggtagaagtaataagagttggcgaaggactggacagggtagggagtgagtgacagagcaagaaagattctgaggcttctggactgggcactgggtgggaggaagtgccattcatggagatgggaaaggccaaaggaggtgcatgtaagggaggagctctaaggggtgatgccagctggacagctggacacatgggtcagcagtgcctgagaggttaggggtggagttgtgactttgggtgaagttgtgactttgggagctgctgatgttctggcataattaagtcctggcaatgaaagagacccctcaaggaggcagggagtataattagagaagaggagagggctcaggatccagccttacaggttgtagaggatggcagggaaacctgagcagccagcagagaggtaggagagaatgggagtgatgcctgcacaggcacctggataggacaacatggaggtcatggtggccttagcagacaccaactgtgtgctgtggcaggggcagatgt

SEQ ID NO: 12466 - DNA, 39667 bp, Homo sapiens
gggaaaaaagggccaggttccctgactccacctgtcattgaattacaagctgggaagctgggccaggcagagctccagttgccagacactgtggccgctctggtaccagctactcctagtacccagtgcaggcaaggtgtttagtgtggcctatgaggatgttgtttaccaggcagcaacctcatgaataggcaaaaggcctgttttgaatgcctcctgtttagaagtctgaaatgtcacatccagacagtttggaaacattttaggtggagtcaagggcagagaccagaagacattcatagatctgcagttgcagatggagactttgttccagctacccatggtgtgagtataccttacgggtgctatttggaataggaccttatttttgttcagtatattggacaaagtaattcctgcttccaaactcacacagtatttatgtggccccggctgtctggcttatccacctgcagctgtggaattacttatgaagcgcttaatatgcagcctcggtttctttatctgttaagaatcgggataactggggcttctgaaggggtagggtcatgtagcctggtggttaggacctctggctttagagatggacaggttttggtttgggctctggctcagctgcctccttgctttatcagcttgagaagttaataatctccaagtttccttatctgtaaagtaaggaaaataataactacctccctcataggttgtagttaggaaaaagatgttgtgaggctcaggtggtctgagggatatagaattgcttctcaaacatgatatgttgctttgcccaatgcttaggagggagttgcggttaatagttgaagtgttctgcaagtaagtcttttggatcagtataaggctgtgataattcttattatttggtttgtgtccgtgcatgaaagcagaaagcagccagaggagtccatgattcaaggagcatgagaattactgtttgcaacaccatgttttctgaattccagtataccatcagttgtaagatatgcttaaggttggacgcggtggctcatgcctgtaatcccagcactttgggaggccgaggagggcggatcacttgagatcaggagtacgagaccagcctggctaacatggtgaaaccctgtctctactaaaaataaaaaaaatttagctgggcttggtggtgcatgcctgtaatcccagctactggggaggctgaggcaggagaattgcttgaacctggaaggcagaggttgcactgagctgagattgcgccattgcactctagcttgggcaacaagagcaaaagtccgtctcaaaaaaaaaaaaaagttatgcttttaatctaaaagcaaattttcagggagaaaaagagcacggctctcttaactgtatctacttaccatatgcatctgaatttcagatgcgtaaaaatgtagaaacaatgcgagtcttcaaatggaggaaataatgcctgtgtgcttatataatttgaataaaagctgtgctgtttggagccctaaacttcaaatggatgacatgttaaaagcttccaaacccacttttgatcaaaaatgggtggaacctatgtggaccagatttttcagctgtgctgaaagagtaacagcaaaccagagtcattgggcgtggttgtgccaacgatcagctcttagaagaccataccaatcacattttacaggattctattcatgaagattctgcatatctgtttccatgttgtttctgaccattaaggagagttgccggtattgacagatgaggaggctgggctgccctgcagcttgcttctccataagcacaccatcaaaaacatgtccacattccagtctcaccttagcccatctcctcattgggaggagttaggctgcagcatgaatgggaacaatgaatatggaggtttcttcagaaggcgatattagagcatttaatatactgctgttcttgtgtattctattggaaagaatgggcaactgcacattaaccttactgtaagtgtgatgcatttgaacatacagttaagaatagctcaaagaatatgcatttctgctgtgagtggttttgaataaatcaacataatagcccatggttattaacatattatgtgaattggacaatgatatatactttgaggaccttgaactaaatccaccagctaagagcaacccgtaggaggggctccagaaggaccggagttctgggtgttgaggttgtcatacaaagaaatgaacagcagacaactggcagaagaattttctggtaatactcaacccaaagtcaattttcaaatgcttggactgcagcacagaattgactaatgtcagattaattgaatttggacttctaaatgtgggtcagtttgggttggaagtgattttattatccagaaacttctgtgtacccctcttcccccacaagaaatattcagccataattttcccctgttgctgagcttctcttgcaaagtttctgagaagcagtgaatctttctgttagatttcataagaagtagtgctaggcttttgatataattacgtttagatttcaaggaaactttcagtgtgttgaaaaataaattctaaggcataaaggggaaggagtcctcggctgagacccagacagcccgagtccttagcccagttagaaacttgccatgtgaccttgagcaagtcttggcatgctctgcctcatggttgaacattttttttttttaagtggggagggttatatatgaccttctttttgtccctttagctcggacacttagaggtttagtgatctgtgggttttgtttgtttgtttttgtttgtttgtatttttggtgggagggggctagagtacaaaatggaaaagaagataagtagacaggggctcataatctttgagaaccaggattttccttaaattgctctcttttgaatctcctggtaccctttaaaaaacctctttacctgggtgcgagtcttcttccgtgacacttaatataactttatggacctcagttagactctgatgtccttttcaaaacagtgttgttttttaaagtatgaagtgcttattaaacccgcttaggagatgcagtcctaggaggccattgatcacacgtgaaaacactctagatataactctcctttcaaaaaagtggctaatgaagtatataccaccttcctattttgaataaagtgctatgactggacaaaatagaacaactttttggacaaaaaggctgctggagccgctgccgtctctattcttgcactgcttgctgttgacagcccatgtgtgaggacactttgttagtgacatttagccagtgattggcccatccaaaaggcggttacccagaagccctcgtgagcaagccaggatgctgggagagggatgggaggtggccttttggaaacaaggggacatggctgggttcttgtaagtcatgtggagagtatgatacacctctaccctgccatgccatggcagctgggcctcgcagagatggacaccagaattcacagcaccagagttcaaacactaaacacgggcagctggacattggccttgggaggcccagacgtggagcactgtcctggacctcaggctgtttcagggacctctgtggcaggaattgactacccttctctttcaggctcagccatgatgtgcttggctgttcccttgggctctctcttctggaagctcgtcccgtccgcaggcccccttgctgtacttgtaccttcattctccatctctcagcttctgcgcactctgaactttggccattcgcatgctgccagaccccttccaactcttggactcctccttacatccctttaccgttggctcccaattctttttttttttttaatttcccaattaaaacaacaaccaccaccaagaacaagagttaggccctgcctacccttctttggatggggtgtttgtgccaagtagcatcaccaactgctgttcatccttgacatgggtgtcctggggtcaggtgtttcctctggcccagttagcagggaggaatgtcatatggtttagaaaggagggcccagggctggccgtctcttggaggggcccgggatggggtacgcccccttggaaggggatggtggttgcggtgggcgctgtaaatgttgtgtccagctcagagggtgcaacagtgtctgtaactcatattctttttttttttttttagacagagtctcgctcctacacccaggctggagtgccgtggtgcaatctcagctcactgcaacctaacctcctgggttcaagcaattctcctgcctcagcctcctgagtagctgagattacaggtgctcaaccaccacgcctggctaatttttgtatttttagtagagacagggtttcaccatgttggccaggctggtctcgaactcctgacctcaagtgatccgcccacctctacctctcaaagtgctgggattacaggcgtgagctgccgtgcccagccagtatctataactgaaggctgtttatttctgcttgcctaacccgtccaggaggatgtgctggggccatctgaacaaccattgacattcagacattatttagaaatggaattgggaagtgtttaaaaggcatagactagtctggccttctgcccattcagagactgtgtatgtagtcagtgtacagtgtattcattgagggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagatcaccgtgggaggtagcaggagtcagtctttaaaaaaattattgggccgggcatggtggctcacacctgtaatctcagcactttgggaggccaaggcgggtggatcatgaggtcaggagatcaagaccagcctggccaacatggtgaaaccccgtctctattaaaaatacaaaaatcagctgagtgtggtggcaagtgcctgtaatcccagctactcgggaggctgaggcaggagaatcccttgaaccagcgagtcggaggttgcagtgagccgagatggtgccactgcactccagcctggcgacagagtgagactccgtcttaaaaaaaaaaaaatttatatatatatatatatatatgaattaattaatttaatgttgcattaacgagtggtataaggttcttagccctttgtctggtatctgctgggtgttcagtattcatttcctcgctttccctgcatattttgagctaataaatgtttggggacaccactttcctgtagaatctcatgtaatcccaaacagatcctagctgcttgctatggcccatctgcgggacccgcgtcaaggctttcccataaaggagagccctgcgggaatcatcatgtgccaggcactgtgctaggctctttaggtgcatcttgaaacttaatcctcgtgacattttggagtagatactatcatccccacagaaggtactgaagtctcaagcacattaatagcttacctaaatattgctaagggtcttccagatgatctttaggaaattttcagccaggggagagtgaaagctctatttgctatagttaaagcaaggaaccctccttcttaaaaaattatacagttattgagatataattcacataccttacaattcatccatttaaagcatgcaattcagtggttgtagtagattcaggagttgtgcgagcatcgtcacagtcaattttagaacattttcatcaccttccacaaaacccccgtgtctcctagtagccactccccattttccctaagtcccacagtcctaggcaacaactaatatattttctgcatctatggatttgcctattctggacatttcatatagatgaaatcataggcccgtggtcttttgtaactgacttctttcacttagcaaatggaagggtttttgatggaatcttagctcagatgtcgccctaggcttggccttctggaactcactgttctcttgcttccttccaccctgcctccctacccgctttgctacaagaagacagaatgtagaaacccccagttgactttttgagtagaaatgagccatgttctatttagtggtagaatgtttgctgggttagcccaggacttcagatggagtgcttcctcctttttaataccttgtgactgctgtgttggcaagcagagggttaaatgctgcaggaggacatgggagagtttttgctttgagggtccactggagcaagagaagcttgagagtctgtctctgagatcycagaacagacatgaagatatggtaccgattcccttggtgctaaaaggaactccaggggaatttcaggaaacccctccttttctcrtctttattctcaccccgtccccccgccacctctctccccaagttcacactcaggagggaggaatcttttaccttttccgttctgggcagcagctgtagggaatgttatcagtgttgggactgggcacgggaccaagccttcctggtgcctggactgcaaccwagctgagagctgacatggcagggcragttgtgtgtgagttggctgcccctaggctcataggcctagcacaatagagaccctgtcaatggagggacactatcaggcaggtcactatcaatgtgacagacactatcaggcaggtcacattggtgcagatccttggaggactcccccccaccccccatgagtggattcctccaggtcaggggctggctgggactgtggatgctggagtaagtggaattgtgggtgcactctgcttcagcagtactctccaaggagaatgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcacaccattctcctgcctcagcctccagagtagctgggactacaggcacccgccaccacgcccgactaattttttgtatttttagcagagacggggtttcaccgtgttagccaggatggtgtagatctcctgaccttgtgatcctcccgcctcagccttccaaagggagggattactggcgtgagtcaccgcgcctggcctttattttttatttcttttgagatggagttttgctctgtcacscaggctggagtacggtggtgggatctcgcctcactgcaacttgcgcctcccgggttcaagcgattctccagcctcagcctcctgagtagctgggattacaggcgtgtgccaccgcctccagctaatttttgtatttttagtagagaccgggcttcaccatgttggccaggctggtctcgaactcctgacctcaggtgagcgtcctgccttggcctcccaaagtgctgggattacaggcgtgagccactacacccagccaatcagttgcttttaaactacttaaataaaaagagccaacccaaaatcttgtgcatgcttgggaaactggcagtggaatatgagaagtttttatttgtggtgcacacaggtgactcgggctgttgtgtattggttcttgcctcgatctgtagcaagcaatctgttgtttcttgcctgccttttgggaagaaatgaaaaaagaagcagcacgagtctccatacatcatgattgtgatggcactgggcctgagaccttttctgctgtccaggtaaaaatgtgaagaccatggttttgaggtttcttaataaattcaggtgttaagtgccaagtgatgctcccagcccctgagctagagcaactatgctgttcatgtccccaggaatggaagtggaccctagttaggtgctggtggccagccatgtgtacctagggcagggccaggtcgtgtgtgtgtgtgtgtgtgtgtgtgagagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagrgaaagaaatgttgaattatcatcttggtgatggtcaactctgaaagcctaaattttcatgatcaccaaagtgtttggatttaaaagggtggctcactccgtaattccggcactttgggaggctgaggcagaaggatcacttgagcccagaagtttcagactaggctgggcaacaaagcaagacccggtctctaccaaaaaaaaaaaaaaaaaaaaaaaaaaaaatcaaaaaaattagctgggggtggtggtgtgctcctatagctccagctactcaggaggctgaggcgggaggatcgcttgagcccaggggtttgcggctgcagtgagctgtgattgcaccactgcactccagcctgggcgactgtgagaccccgtctttaagaaaaaaaaaaaaacaaaggtcacaagacattcttggctccgccctgcagagctgcttcccgatctccttttttatttgcttcccaacctgcgggcctcagtgtgactcaccacaccggactgcctggccctgctgcctgccgcccatccttgcggcctggacgactccatgtgcgagttgctggcgcagcgtccagaaaacagaccacaccccaggaatgatgatacgttatagcatttctctgctctgtaagagaggcaccagggtcgtgtgctgggtctggggtttgtccattccacatccggtgctgctgttgactctggtgtcggccgctggtgagctggctgtagctggtcacctctgggtggtttctggggcggtcgcaggctgactaacayaccaaaggtcagccagggtgttgaagctggcacctttcttcctggagcacagacgtcatcttggatcttttagatacttggacttactttatgcagaacattctggatttgtgaattagatggactctttattattttgtatttggattatttctttaaagagatcagagataaaaatatcattgttttgccagtttgctaccaccagcccacacccctcttcccgttgtccaaaaagggggtggttagagttttcttgagtgactgggctattatgattagcagattactaaagctgtgtgattttaacaagacgtaaacacatatgggaacccctccttccatatcttgctaatgtcaattarcaacatattaatcttgctaatgtcaatcctgtcacttcatacatttataaatattagggacatttaaaagagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccayaggcarattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctggctctgttgtccagatcataactmactgtaaccttgatctcctgggctgaagcaatcttctcaccttagtctcccaaagcatgctgggattacaggtataagccacagtgcccagcctgaaaagaatactttaaatgggcggggtaatggtggcttatgcctgtaatcccagcactttgggaggcagaggcgggcagatcacctgaggtcaggagttcgagaccagcctggccaacatggtgaaaccctatctctactaaaaatacaaaaattagccgggagtggtgatgggcacctgtaatccgagctctcctggaggctgaggcaggagaatcgcttgaacctgggaggtggagtttacagtgagctgagatcgtgccattgcactccagcctgggcgacaagagcgaaactctgtgtccaaaaaaaaaagaaaagaaaaaagaaaaaaagagtatctttaaatgaatggcaacccaatttgcaaatgtattttttttaatgttgccaattactttatgtgtttaaaaaatatctttctggtttactagggtattcttcaaaaaaagagaaaagattaaagctgcacagacatgatgatgtaaaagctagtagcttctcaagctgtgaaaggtctgtggtgcagagaatagctccctrtgagctgaattttgtttgctgtggtgcagcatgggtttagatcctacctggttagtgaaagagataatgtgaagtcattgcatttgcatttgtcaaaatcctagttttccacttacctaatagttttttgtttgtttgtttgtttcattttgtttttaaagacaggatcttacagccggggcctgtaatcctagcactctgggaggctgaggcgagttgatcacctgaggtcagragttcgagacacacctggccaacatggtgaaaccctgtctctactaaaaatacaaaaattagccaggcgtggtggcacrtgcctgtaatcccagctactggggaggctgaggcaggagaatcacttaaacccaggaggcgaaggttgtagtgagccgaaatcacgccactgcactccagcgtaggcaacagagcaagactccatctcaaaaaaaaaaaaaaaaaaaaaagacaggatcttgctctgtcacccaggctgggatatactgrcttgatcatagctcactgcaacctttagctcctrgactcaagcaatcctccagcatcagcctcctgagcagctgggactataggtgtgaattaccatgcctggctaacttttttattttttgtagagacagggtcttaccctattgcctaggctggtttcgaactcctggcctcaagtgatccttttgcctttgcctcccaaagtgctgggattacatgcgtgaaacaccacacctgaactagtctttttgttgttgttgttaaagtgagagacccagaccaaaatcatctttcttctcccaaaatgctaattattatttgttttaagttatagctccagattaccttgtaggattattcacattttctttctaaatgctgttcttgaaaggaaccatctattgacagtacatcagaaattctatggttcctttatgacatttctggggaagtaaatgaaaggtgtaaattaagaaaagcaagtgtttgcggttcccactttaaccttgtgttatgttaagtggctttgttgaagagggctgtcactgttcttgaaaacttgggaaaatccatagcaagctgtgccattagttgcctttgggagcacaggatgtttgatgtgaaaattatatggacacatctaattgggtgtattttcaccccaccagatatcaagtaaagaggtgactcttccccctcccctgcatttttagctaaattgtttaacctgaatttcatgctattaagaattacatttcagtaatccacctgccatttttcaatgccttttgtttagtagcatgtctgtatgatccacctacagaacatttctagacatctggcaagagctagttatcatcccttcctgatttggggtgctaagacctgtggtccccttcttccaccgtaatttacattyttccctgagtcctgcaggaactcagccaggcagtggaaagaaaacagaagctctgtggacctctgcttactgtaaaatgggaataataattcttatcctgcctgtttcccagagttgtatattcttttccaataaaatgtactcaaaattaaaatacaaagcagttacacagagataagatagtggtaattatgccaatttaaactccagaattaaaaaataagtttagtcacataccatgcagttcacccatttaaagtatataattcagtggttttttgtatatttgcagaactatgcaaccaatatcgccattgtagaacattttcctcaccccctaaaagaaactgtacccattagctctcactccccatttcccccactctgccttctcccccatgcccaaggcaactgtcaatctactttctgtttctatggatttgcctgttctggcattagatatatacatgaagtcataaaatttgtggtcctttgtgactgcttctttcgcttaacttaaatgttttcaaggttcgtccatgttgctgcatgtatcaggacataatttctttctttttcttttcttcttttttttttttttttgagatagagtcttgctgtgtcgcccaggctggagtgcagtggcatatctcggctcactgcaacctctgcctcccaggttcaggcgattcacctgcctyggcctcctgtgtagcaggcccatgccaccacgcctggcttgcttatttatttatttatttatttatttatttatttatttatttatwgtatttttagtagagatggggtttcaccatgttggctaggctggtgtagaactcctgacctcaagtgatctgccctccttggcctcccaaagtgctgggattacaggcatgagccactgtgcctggccaggactttattccttttatggctgaataatatttcattatatggatatcccatattttgttgacccattcatcagttgatggcaagcttcagaattaaaaaaaaaaaattaagctagttcatatttgctttaattttccaaatgatccctttccttttattgcaagttaagtgttcctatggtaatgactgttatggggcaaagatgatcaagtctatgagcggtccacacagttcaacaaatatgtacctcagcacactacctggaaccagacattgggtaaagataactttagaattcatggtccccctgagacactaaagactttttaatgaatgcaattagtaactttctacttactgttactctttttattttattttttgagcaggatctcactgtgttgcccaggctgaagtgcaatggcccaatcacagctcactgcggccttgacctcctgggatcaagtgatggctgagactacagtcatgtgccaccacatccagctctttaaaaaattttttttgcagagatggggtctcactataggctggtcttgaattcctggcctcaagggatcttcctccctcagcctctcaaagtgctgggattacaggcatgagccaccacacacacccagtttgttgctctttctgtaggttggctaaggattaagatgttatctccggtggctgaaacatgcctctgataggtgctatctcccttgtcttcattttcacgctggtggtaatcctggaagccgcagggatcagtcagatggcaacagcagattctttttttgttttttttttttctgagatggaattttgctctgtcacccaggctggagtgcagtggtgtgatttcatctcactgcaacctccgcctcctgggttcaagtgattctcctgcctcagcctcccgagtagctgggattacaggtgcctgccacaatgcctggctaatttttgtatttttaatagagacgggggtttcaccatgttggccaggctggtctcaaactcctgaccttaagtgatccacccatcctggcctcccaaagtgctgggattacaggygtgagccagtgcgctgggccagccacagcagattctgacaggtgatgcccttgccagcctggggagccttttggttttgggtttggtttttaaatttgttactgttttggtggttgtttttacctgttgtaaatattaagaagcctaggcatgatgatgctctgaagacaggaaaatttgttttgtcccgatttgccacacggactcctgcctgcatctgcgttgatgtggccacacggagagctgctctgctcaggagatccagcccgggccagcagctttataatcagttctgatcgccaccctgcagggctgtttttggcattttaatgtcccttaagtactttcagaagaaagttttcaaggaaaacctgaattttttctttattggctgcacatgttagacatatgaagatgtgtttcactttacaaagtggggggaaccctcaacaatctttaagagatccctaaaaactgagggttgtttcagaaccatctaaatccaagaacgttggacctgttatacttattctggcagatggacccatccctttttttttctgagacagagtctcgctccatcgcccaggctggagtgcaatggtgtaatctcggctcactgcaacctctgcctctcgggtacaagcgattttcgtgcctcagttacccaagtagctgggattacaggtgtgtgccaccatgcccggctaatttttgtatttttagtagagatggagtttcaccatgttggccaggctggtcttgaaatcctgacctcaggtgaaccacccccctccgcctcccaaagtgctgggattacaagtgtgagcactgtgcctgatcgccatccttttattggtgagaagaaaagggagcaagatgaggttgacccctgcatcttatgtgtgtactgtctctgcctctgtacacacacacatgcaccacagacacaccacacacacacagcccacatacacagcccacatacatgcacacacaatttagggttttcccccttctcacaaaaatcctctttaacgtgatttttactaataaagttataaatgtctggggttagaagacagccaaagttttgggtggcgcaagagataattcatcccagactccacaccccttatgccatgaaaacttcacctctccgtttcaagctgagaaaccccacatacactgcagatacattacaaggcagctaccacatcaccaaaggccaagcagaaggcattgtggatgccctgggtatatactctctgacacagaggtgactgcctaagcagtcagatttgcgacagtgtgatcctttttggaattcatatactggggcaagtattggaaccaaggttgccagcgaatggggctggcaagtcttttttcaagtttccttgtgtgttcccattctgaacaaggtggtgtcaagttgatcctgcctgtgggaatgcattgttcttgaatatttatatctttgtatgctcccattgggatttctcctttcataatatctgaaaagaacttgttttcattaaagccatttcaatttcgtacatttttatgcaataatttagtgtttatggtgtctcttaaccaacatggcttgttttcataarcacccgagaaggtttaaataacattttctcataaattagccctcgtttgcacacttattcagttattgcatcatgaagaccctctggagtttgatgttgtcaggaaacatattagcagaaaatagtgtgttattatctaatgctrataattggttagtggaaatgagaaaagaggatatgtaattggggttcctgtggctaacaagatgtgaattatgaaagcatttccaggagaaattccaggggtgttccaggaacctgttatttacattttaaaacatttgattcccattgaaaggggaggagggcgctgtttaccaacactgctttctttttcagagcaaatccatctaaatttcctgagtggtagctagatctcctaatacacctagcccctatgttgttttgactttgcagtcccattttaggctgctaacgttctttttgtaagagatatgttggcttttaaagagaggattacctagtacacatcacaagtcctgatcagaccctcttctccctcttggccccgtgattctgcccagtaatgtttacagcacacaacacgcaccaatactacttcccaaaggctgcttgggagaaggagcgtacctttagcaagaatctcagtataagcacagtataatgctttcttcattagctagattcacaaagctttctgcagcctgtgctgcttgaacccgagcttctgcttaatgttcttccatagccagtcattgctgagtaaggtggatgggcttctgtgttatgcttaaacaagtgaaatcaactcctgttctctcaaagtcattgatgagcatggtttttcatgcttgctcgctattgacttgtctggaaagattatactgttaaggacagagactctgtcagttgcatatggaaataatggatataaagattgcaaggagagttcattttccacctgcttgaggtcacattgaacctcatccctgttgcggaaaacaaatgggagtgatagctggtgccagttagtgtatggatgtcctcgaaattagatgtgccttcaaaaagacttgatttaatgttagccaggtctgtttgaacttcattattactattattattttgagatggagtgtygctctgttgcccaggctgcgcccaggctggagtgcagtggcatgatctcggctcactgcaacctctgcctcccaggttcaagcaattctcctgcctcagcctcctgagtatgtgggattacaggtgcctgccaccacgtctggctaatttttgtatttttagtagacacagggtttcaccatgttggccaggctggtctcgaactcttgacctcaagtggtctgcctgccttgacctcccaaagtgctgggattataggtgtgagccactaccattttttttttttttttgcgtgccttggttaatatctcaagttcagataatgttaaggttaaccacttcatcttattacctttcatcccagtaaagccttgaccttcacatataaaactaatttagtgtcaatacagttaaaaagtgtctcctttattcagaattacccatataatgtctttttttaataactttattccaaacttgaaaaaaattattatctttacccatttttccctgtactgtttatgatacaacaattaaaaaaatcttatttccaatttctcaatatttgataggtacactttcccccccacaggaaaaaagaaacagttgacaaaactttgttttaaccagcaaacaccttttgaaatggtgctgcaaattcctattcatgatgccatatttctaaaacactttttcttggtcatgttgaacttttattcagtaaaagaaatcttcattctgcttgtgtgtgtgtgtgtgtgtgtgcacgtgcacacgcacatgcatgtggccttttctccttgaatgtgacttattttaataaatttaccctcttattatataatggccatgtccagaaatcggggtgcatcgcttctgtacgtagagagtcaaggtcctaacaaacccgcccctctgtgttctgctagccatacagaagtggagtgtgttggaggtggacacaacccttagaagtcatccagcagccagcatcctcatatgctgtgtcaagctgagccccagaaattcagagagtacagctagtcagtgggagggtggcagtggcagtgacactgaggccccatgctctgtctgtgcgaggttaaggaggggtgagcagtgctttgtaaaggtatgtgaaaaagtggtctctttctatgctcattctgttttgccttctgtttggagccttgtctttttctcaggtgaggtctttgagggctgaggtagacttcatttctgcatgccttgagtgcagagatggtgattacattccaactcgtgccaactttgagcagagtggctgtgtgctatggaggtagtaagggaagagggaggtgccatgtgtgacctggacacttgccattcgtgactctaggacactgccctccacatatactgatagacacacacacacacacacacacacacacacacacacacgtgcaagtgtgggcccatactcacaccttgccactcacaccttgccactcacacatgctcacattaaaaaaaaataataatgagaaaaaaggattgcatacatctgccatgtgagtgatgatatcccggtctggggaggaactgggcttgtctttacgataaaaatggtagcttatctggagccctgatggcagtttctttgcctttgcagtaagttgacagtgtatttcagatgtaattagttcccatcaaagttacctcatcttcagaggtgagaattatcgatggtgcataaagctggatcagtgtgacctgtaaagaccttacctgtctccaaggttacgcgtgtgtacgtggggttggctggtttggatggttgctctttgttttttggcatccttgtgtgtgaatacatgataagaaatatgaggatgttaccttctcaccaatttttaaaaattgtcagttcagtactttgcttttttagtggaatggcccttagcaatatccttcttttaaatggatttcttattgttccaaagatgtggcatttccaaaagaaaattcttccatttatgcatagaaccttgaactctagtctttaaaaatctaggctttagtttcagctcttttttagctgtgtggtcctggacaggcccttttacatctagacttggagatttaaagaaaatcataaagaattaaatgagatgatttctaagactcatttcattttaaaactctgatctttcagagacgcacaaatccattccctcttgctgtggaggagaaaatacatgaaaatctgaatccatatgcatttgtcagggttctccagagacataaaaccaataggatgtatgtgtttatatagagagatttgtaataaggaactgrctcacccagtcatggaattccataatctgcatcatcaagtgtcatggtctgtagctgggaagctggagacccaggagagtccatggtgcagctctagtctgagtctaaaggctggaggactggtagaactgatggtgtaattccttttcaaaggccggtgggctggagcccagagatgctgctttagctcaagcccgaaggcagttactcaggaggatgccggctggtttggaggaagatcagccttgtattctgttcaggccttcagctgatgggctgaggcctgctcacatcaaggaggaccatcygccttactcagtgaatgttaaacttatctaaaaatatcctcagagaaacatccagaatagtgtataaccaaatatccgggcaccttgtgacttagtcaaactgacacataaggccaggcatggtggctcacacctgtagtaatcccagcactttgggaggccgaggtgggcggatcacttgagaccaggagttggataccagcctggccaacatggtgaaacccggtctctaccaaaaaaaatacaaacattwgccgggagtggtgttgtgcacctgtattcccagctactcgggaggctgtcacaagaatcgcttgaacccgggaggcggaggttgcagtgagctgagattgcacccctgcactccagcctgggtgacaaagtgagactctgtctcaagccacccccccccaaaaaaaaaaaacaaaaaaccctgacacataaaattaatcaccaccagagttttctgaggcaaagaggagtaaagctgttgcctttttcttcttgcctgtgaggttggttgagaktcttctaacagccaacaggtgttggccaatgttactctgattgacacctttctttttttttattcaggtttccctctgtcacccaggctggagtgcgggggcacaatcatggctcactgcagccttgatcttccaggcttaaccaaacctttcaccttggccttctgagtagctacaggcctgcaccaccacatctggctattttttttttttttttaatttttagtagagacgaggtcttgctatgttgcccagtctagtcttgaactcttgagctcaagcagtcctccagccttggcctctgacagtgctgggattataggtgtaagccaccacacccagccctgagtgacattatttcatacaaaattctcatctctggaggcctttgtatttttaggggttttgtttttcaaatgctttttacctctttctatacttgttcatttttaaatgtttcctggcagagcaattagtattttctggcttactaggtgctattcgattgcattagcgtttgaatattacccagctagttgtggagtggggcagtaagctcataaagaagcaagataatggaatacacaaatattactacgactttatgggtggcataccttgattcttgatccacgtggctgtgttcagatctggttagcacacattgacatcaggggctgagccaccagtgagagtcaaacccagcagccctgtcagtctaccttctctcttgacttgatccagcctcataacttcactttccgcaggagaaacacacctcttgaggtcctctgtcacaaataggcagtgtttctggagaaagccaggaggcagattttagtgctgttcagcatctgtggtctctactttctggatctggtgcattatggagaccatgaaatgacatgaaatagctcagtgctgccagtggcggtgacagggacactagaggtgaaggagggcccttggggcaattccagcaggtgggtggtggctgaaggtccttgtcttctttctgcagagactggccacctgcttcattctttcaagaagcaccaaatccctacttcagtactttgcccactcgtcatgtcaggagcatgaaactcacgaggccttcatttacttttatcctgtaacaccttcaatttttcccacatcctcccttgattcgtggatggacaactatggaggccaatctggctgaggtgaggactgcttgagtctaaattcctctctcctcaaacccaattcaaactggcctgagcaaaatgaatgtattgatccataactgaaaagtccagaatgatcaggcatcaggcatggttgcatccaggggcccatgtattagaaccatctccttccagttctgggctctgcttgcctcccagttggttttactgcacagaggcttattcaagtccagagagatcttatctttccctacaagtctgtgaccttgattctgaacctgcatctatgggaagggcttgcagtgtctgagtgagcttggactgtgtaaactttcccacttctgaagctgggggtggggttcactccactaagctacatggctctagagtcagggggttgccccctaagtaactggcagtattgttaccagaaaaatcatgaatggacactgagcagaaaactcagcagatgtttatttcctggtctttaggatttgttgaagagttttttatttgtttgttttttaagaaagactcaaaaggaaaaaaaaaaagaaactatagttattttctcatgatataaaaagattctgtagttgtatatacatttgaactttttgtaagacatctcctacccccctaaaattggaagtcatttattaagactttgtattctgtaagaggattggaaatgaataattaagaacattaaagaggaaagcagggggtggtgggaaagtgtggtcttgagggggtaataaacctcctacaggccacacacacacaagraaaaaaaaagggcaataagtgtagcccagtaacataaggtggggaataaggttaggggtaaggttaattctacaagttcaaagccagtagcccctgatgcgctgttggacgtgaactataaatttggctctgaggttcccaggcatggaagaayatctagatctgtacagagaggttgtgtgtgtgtttaacatttccataatgtacaatttcctctaagagtaaaggccatgaggaaatgcccgtggaagataaaggagaccatgtggtctgtggcaaccatggatacatttctttcccaacgcattctctgaggcactttggtaactctgcctctttgctctcagcattgtgttagaaaataaagccagcagacwaggattaaaccctcatgttgctgggttccttctagaaacaattggagggctaaccaagtcacctttggtggaaggcagtaaggtgagtcattgctgtggctggactgaataggatagccttagctgtaaaattgggctgatctttcaaatggactcatgcttgccgaatgactcacgctcctgtttacaaatcagctctgtgaagaaatgcagagtgggaggctctgcttgccagacggagaccttagacctccaggggtggagaacggagtacttcctctggtgctcggcttcccttcctgggggcagatctctcagcttctggttggtggctctcaaaatccagacacaaggtcagctgcagccagcgtgggccctggagtagctccagttatggggcagcaatggccccctctcattttgagagctcactttgcctgtggatggttttaatccatctggataaacttgaggcccatgggaataccatatactatggtaaccatgtacactgctctaaagatgtggctgctgttgtataactttttcctttatttttgtcaatttcctattttccagrgtcttgcatacccactatgtctactgtgatagtgaacgtaaaaacatacaagatgttggtgttatcctcaatctcttattcttaatcctgaacaaattacatgaaaaaatcgttcatggagtttttcttcatataaaactttttacaatgaacataaagggcatagctatttcttttttttwaaaaagaaacgtagaatattatttcttggttgtgaaatcgcccttcttggaccccaagttgttttttacagccctaaattctcttgtttatagagcctgtttatagagccatagacaggccaatgggtctctacagcaggcacctgcatgagttgactgggacctgagctatattccccctctgccatttactagcagtgtgaccttgggcatgctccttacagtctctgagtcagtttcctcctctgtgaaatgggcatgatactacctacctcataaggtaggggtgaggattaatggagtaagaggcacactcctgtccagggccccagacagagtaggccgtcagtaaactgtagcagctattgtgatagggtttgaaattcaaattaacgcatatttcttgagcacccaaggtgtgtgctgctggatctttcaaggggtccagaattgrtagtatagttgcttttctcaaaagactgtcgcctggcagaggaaaaggtgttaaggtatgagtgaagacagatcagccagacatggtgccgcttgcctgagatctcaacactttgggaggccgagataggaggattgcctgagcccaggagttcaagaccagcctgagcaacatagcaagattctgcctccmcaaaaaaataaaataaaaataaaaagattagctgagtgtggtggcgtgcacctgtagtcctaactgtttgggaggctgagacaggaggattgcttgagcccaggagtttaagtccagtccgggcaacatagcaagaccccatctcttagaaaaaaaaaaaaaagatcagctccccaaacagctgaagtattaagtggaaccatatgtaattgtatttttgtaggacagaaatatcagcaatttcacataactaatagattcagtaaggtaagttgagagagaaaatgctagctaactggttcttgagaggctcagaggaaggggaggccatgcccattaggagaatggtgggtaggggtgggaatacacaacaggaaggctgcctggaggaggttgcatttcagatgttcctagaagggaccctgagctggatggcagggaaataggagagttctgatttgtgctgggaactgtaatccctctatcatggagcttctatagaaatgtgggttagggcagaaaggaaggctgggggctgtgtgtgccttggtgacgtgtccccctcgctcccgagccttactctgttcccctttcttcctggcagcagagccccctcccttgctgcactcagggacatgactgtcagcacttctaccccccctcagacttcactgtcagcactcaagtcttcagggacatgaaaaggagccactccttacaaaaagttggggagccctggtgtattgaggtaggtctcggagcagaatcacggtatgagatgagctagctctaaaatgaagcygcccacccaaagtttacctctctctagggcagggcccatccactgygatccctgaattcttgttgggtcactgtcattttgggtgccatgatgtctgggtgtgctgaccgctgatagggatatcatagccataaaaacgcctgtttacaaggagagggtggagggtggtgctcgcatgactccaggatgcctggctcccagtgaaggccctcgtgatccagtgccacacgtaacttctgtgaaaatgaggagcacaacattatcccattaaacttggccccaggaagtgtctcttgggactcttcacagttcacaatggaggagaagttaccacctcaactttgccttcgttactagtaatttagaacttaaagattttcttttaaaattcagggtgctggaaaatgcccactttgcctcgacaatacctacctgaggcagccrtgaatggctttactcgcagatgttgctctccaaggacaggaagcattgttaatttcctttaaataattcaatacagtgtcaataccccacactgctcagtgcttgggagtaacagttctcttcaaattaatagtcctgaagaaaaaataacacctagaacatgcttttatcttcagaaaagcaaaagtcaatgcagatgaaaaattttcaaggaactcttaggtttaaacagcaaatgatttagtactartgttagcttttaaaaaaagaaaagtgaatatttatgaaccaaataataaagcctctgtctttaaaaacatttattgtatacctattgggtgctgtgctatgtgttacagccacagggacagaaagcagtgcctccagcaggcagagacctggagtaatacatatgtacataagtcttgctgttggagagacaaaatgtggaataagtcatctttaaaagtttgttctggcgtaggaagtgatgaatagccacataagacaactagaaactgtaaaaatacataaagaaaatgtaaatacctatactcttattacctattgataatctctctctcttttttgagatagagtctcgctctgttgcccaggccagagtgcagtggcgcaatctcagctcactgcaacttctgcctccggtttcaagcgattcgcctgcctcagcctcccgagtagctggactacaggtgcgcgccaccaagcccagctaattttttgtatttttagtaaagacagggtttcaccctgttagccaggatggtctcgatctcctgacctcgtgatccgcccgcctcggcctcccaaactgctgggattacaggcatgaacaaccatgcctggtcttttttattttttattttgagacggagtcttgctctgtcttccaggctggagtgtgtgatcttggctcactgtgacctccgcctgccagcttcaagaaattctcctgcctcagcctcccgagtagctgggattacaggcacctgttaccatacccggctaatttttgtatttttaatagagacagggttttgccatgttggtcagactgttcttgaactcctgacctcaggtgatctgcatgacttggcctcccaaagtgctaggattacaggcgtgagccaccgtgtctggccgataatctcttaatatttggatacatttccacatttctagtcattcatatgcacagaccttaaaagcgtttcgcaaaattggtattatacctcatacggttttgcaatttctttctacttttaattctaggaacactttttgacactataacatgtgcctaattctctttagtaacttcatgtactaaagtggaaatcctctggtccacctattccctgttagccagatgtgcataaaactgaagatgtggctgggtgcagtggctcacgcctgtaatcccagcactttggaaggctgaggcgggcagatcacgatatcaggagttcaagaccagtgaaaccccgtctctactaaaaatacaaaaattagccaggcgtggtggcgcgtgcccgtactcccagctactcaggaggctgaggcaggagaatcgcttgaactcagaaggaagacagaggtttcagtgagctgagatcacaccactgcactccagcctgggcaacagagtgagactccatctcaaaatgtttctggagtctttcggacttttcgctgtcttgcatgcttgcctctgatcttgcatgttcttgggccacgcctatgtcttgattacctggagctgctgtctgtgtgtttaaggagcattccctttaactggcctgggtctgatagagcagggaggcccccttttctctgcattagccatggcctggtagaagatctttttcagtagcctctcactggttcagcttttaataagcatagctgttcattctggctatttatgataagatgatatgaatatagctattctcccatcagagcctggcacatggtaactcattaatctttggttggcggcaggaggtagataaaggaaccaggcacccattttaagtatgaggaaaatgaaacagaaagactgggtttcttccttataactcaaggtctacaggagctgattagatccctggcgccagtgactgagcatttctcagccttgtcctcagaacccagaagcatctcccagggacgtgccaaaatgccacgtttccaggatgtcatctaaatctgtaaactgtgaataggtgaggtacaaagatgccacttatgggctgtgccaacttgggcaagttacccgactgatctgtgcttcaatttctccatcagtgataaaggttcacatacaggctgtatgtaaagcgggagcttgatgagagagctggtgggctcagactggtgcaggcaattggcaagattcttgaggaatcacaacctgatggtgtgtctgtgtgatgggccagtcgctgctggagtagctcagttatgtgttccatgtaggtttccatggaaattcacatgtaacattcctagtacctacttcaagaattttggtggtggctgggtgtggtgggtcatgcctgtaatcccagcacttcagaaggccgaggtgggcagatcacgaagtcaggagttcgacatggtgaaaccccgtctctactaaaaatacaaaaattaaccaggcgtggtggcacatgcctgtaatcccagctacttgggaggctgaggcaggagaattgcttgaatctgggggacggaggttgcagtgagccaagatagcaccactgctgtccagcctgggcaacagagccaagactccctcggctgggggggttggtgggggcagggtaagaattttggtgatctctgaaaatccggatcccacagcatgggtgtgatagaaatggctctgcagagtgtgatgggaacctcttgtgactggtcgtcagaactaagtttgagtccaacactcacttttttggcaaggtgcttccccgctccgtgatgcaattcttgcatctgcaaaacaggcggtggtcatgggatattcccgcagtctgctccactgggtacctacagagatcccttgacatttaacacaggcttcctgtgatccaggaactactgtacgaactactgtaactacctcctatattaacttttccaaaccttgatagcaaccttatgagggaggtggtgtgattattcccattttgcaattaaggtaactgagccagagagagagaaagcaatatccataagatcacacagctgaagggtgagagctataaaaattgctgggaatgaagggccatggttcttggccatggttcttggccatggttcagagctgtgataccaaccatcttccacttgttcagggagaaggtgtttgatccttttcttcactcagctgccttaggagttgggaggaaattttgtttcaggatacctaagttcttacaagtctcaacaattgtactttctgttccatctacatttcaaattcattgtcccttctctttctttccatgtaattcagccagattcgaaccctttagatcccttcctctagggaattaaggttggtagaccagctgagtaaatgtgactcagaaagtcaatatccacctgggcagggatgagtcatttctttctagttagctattcatgtacattttaaagctcgccacacaaagtcattacattgaggctattaacatgtttaatagtgacaataatagggtgtgacccatggcatataaccgcattcagataagaagaaagagttttcttttttcttcttcctgtaattgctcagtcaataccattttcayggaaatacttgcaaacaaacttttaaaaagttcattgtccaaagccttccctgattccttgtttccttcctcttcaggggttctataaacttttcctgatcagtggccggggattagcgagatggtgcactctgtcctgattttgtggttgacctacccttttgctggtgttgagcctgtttttattgcattttttggggtgtgtgtgcgcgtgcacgcgcatgtgtgttttttcaggagggggcacattattgctgctacttgcttattaacctctcaatctagaaatttcagggaagaagagacttccgctaaatttgccaagctagacacataaacagggagttagccattttggtgagaggaaatgaaacttttcttgggtttattagaccacatcctatgtggcttattttatgtctgatttctaaaaagcatgtcatcacggtcaaagttttatttttgcttgttagtcatttgaaacaaatatagatattgcttcatttcctgggtactgtatttttcrgtacgtggtatgtatggaaaatttgggtttacacaatgaagtgcactagaagggaagtatttgctaatttagaactctctacattataactttggattagcaagcattcggctaactaaacattttcatttatctcctacccctgattatataaagaagcagatgagacaaccaaagaaatacccctccaagacaaagtgaatattttgaaatacttcctytcagtcttttaaaaaatgtgatttaaaaatcgtaggtgggatcatactatacatgcacttgttttctgtttattttacatctctctatactagaaacactttcctatatatgccacaaaaactgtgaaagtactaatgattatccctcctgtcccttaatatgcttagctattgccccaatgaactcagactgtttccaaagttccgctgttggccgggcactgtggctcatgcctgaaatcccaacactttgagaggctgaggcaggtggatcacttgaggccaggagtttgagaccagcctggccaacatggcaaaacactgtctctactaaaaaatacaaaaattagctgggtacgtggtcccagctactcgggaggctgagacaggagaatcgcttgaacctgggaggcagagattgcagtaagctgagattgcacctttgcattccagcctgggtgacagagcaagactccatctcaaaaaataaaaacaaaaaacaaaaaaccaaaaaacaaagttccactataaatagtgcaactgcatctcatgtggcagagggtggaagttgcaaatagtgaagagagagtgattctgggacattccataatgcccccttgatgtatgtgacccatcattgcttcgcatgtatagccccggattgttctgtgtgagtgggccggcaaattcaactcctcctcaccccctctctaccccagttcatgctcactgggtaggatgggaggtgggactgccagattatttttattttttcctttcccacattgtctatctgccaatatttttttgttgaagtcttttaggctaaatgagcggacaaattttctctgctgatcaaccgccgtggtagcatcagtgggcactgcagtgcctccctgggaatttttaatgcctcagtgaggtcatattcccagtgtagagggaacatgacgtagtcccactctacttatcagatgcagagcttgctaccaggaaaacagacgcggagaagcygggatcatttctggccccatttccctcattgttcaccattccttggactgcaaagagatgtcattgtaaacgctatccttttcattttgtatactaagcaggaagcccaggcactctctgtggaggtcttccaaggagctcatccatgcagaagataggagtgttcctgcaccctgcatcctagcctcagtgagcccacttgacaccccccagggtgctgcaagctgtgcccatgtctctccacgttagtggctacctcccttttcccctttcgtcgtgagtcacgtattttctttgtgtctcgtgtgacaaaggtcactcgtagagaagatttgggcctttggtgtgtgacatgtcatccccacagttgattgttttggctcctccccttttgtaatgctgtgaggtgacaggtcagtttttaatgggctagtctgcgtcaagggagagtataaattagccttaagactttgtattccatatagggtttcccatatgagaatatgcagttagcacttagggagaggggtagacgctgcaggggtggttttgacttatctgcctatcagtcagcgtctctgttgacgtacctgtttctcagatagcaatcccttttatgacgtcagcaaggtagatgtttggaatttggaaatggagaggaaccatatttcagcccagactctggaacttaatttactcatttttattaagggcagtgattattaggcaagcagctaatagcagatctgagttcttattcttccttataaggcctgtcctatggaccttattggaaaggtatttattgcatcagctgctgctggtttagtcaggagcaccatcatctttcaccttttacttcacacccatccagtgttctctgtcacgtctctgaaaggccatttcaaaccggtttgcattaagaaaaatcagtagtttcttttttttttagtttggtggaagcgccataggaggccagatttgcttttcctggtcaatgtctggcctcttctgtgggggccaaaaatgaaagaggagcagccacacccttttagattctggccatgtcacagcacacttacagccagcttcagaggccagtgcagcagggagaaaagctcttggctgggaagatctaaattagaggcctgtttgtgctcagagtgaaagtttctgttttggaaaagccagctccctccagaggggagggtggggatgggaaagcaacgaagacaccagagaaagaagaaataagagggggacgtgaggaggcatgtagtgactgactgcaggacatgggacccccctgctcggcttctgctcctaccccaccggtcactgggtcagacaagcttagcctgagccccgcgtcaccatccctgtcctagtggtagcctcttgctgtttagaaaaacagagttgggggagatgacagtagcttgcctgtgatctacacacagggcaggttgggaggggtcctgcacactctgtcacgtagtgctcatcccagctcctgcctgctaggtttgtggcaatatttgtggtaagccttgtggttcgccaggggccagggtgacagatgagaagtccacttgttcctgagaaatgagctccactagaaagtaggagcagcttgtaaccaaccagggggaagtcctgtgtgtaggttgtcacaactctctctcaggacaaatttctttcctcttgccagttgtagaagaacccatgaggaggccgggcacggtggctcacgcctataatcccagcactttgggaagccaaggcrggtgaatcacctgaggtcaggagttcgagaccagcctggccaacatggtaaaaccccatctctactgaaaatacaaaaattagccagacatggtggcaggcacctgtaatcccagctcctcgggaggccgaggcagaagaatcacctgaacctgggaggtggaagttgcagtgagccaagactgcaccactgcagggtgacagagtaagactcttgtctcggaaaaaaaaaaaaaaaaaaaaaaaaaaaacaaccatgagaaagatatatggaggtgagagggaaaggtgtaccctggagggatttcttatggcatcttttactggcttcagaaacacaggtcatggccagacgcagtggctcacacctgtaatcctagcactttgggaggctgaggcaggcggatcgcctgaggtcaggagtcagagaccagcctggccaacatggtgaaaccctgtctttgctaaaaacagaaaaattagccaggcgtggtagtgcgcttgtaattccagctactcgggaggctgaggcaggagaatcgcttgaacctgggaggtggaggttgcagtgagccaagataatgccactacactccagcctgggtgacagagtgagactctgtctcaaaaaaaaaaaaaaaaaaaaaaaagaagaagaagaagaaacacatgtcgtacctgaagggaaggtaggtcctttccctgcccttcttccccatttccttggtaggggcagcagtgtctggcacaggctcctgacccttgtgatgtaatgatatgttggggatgtttgtttcttcttggacctttcctgtttgggacagcaaaatctacaagatccaggtctccgttggggctttccgcactgggatcttccttggtcaggtcacttgcagctgtttttcaaatctacactcaatggcatgcaattctgtgccctgatttaacgtatgagggtcaagtgtgagacgtgggatttttatttaaaaaattgtattttaggccgggctcggtggctcacgcctgtaatcccagcactttgggaggccgaggcagatggatcacaaggtcaggagttcgagaccatcctggccaatgtggtgaaacccccgtctctactaaaaatacaaaaattagccaggcatggtggcgggagcctgtagtcccagctactcaggaggctgaggcaggagaatcgcttgaacctgggaggcagtggttgcagtgagctgagatcgcgccactgcactccagcctgggcaacaaagtgagactctgtctcaaaacaaaacaaaaaacaaaaaaaatgtattttaaaatatattatgatcattgactttttcttttggtctcctgttctacgaattgtaatataaattcgtattattgccaccacgtaggacacagaacagctccatcgccctgtacatgtcctgttgctgcctttgtgtagtcactggagatgtgggttttatttttattattttctccatttgatagatagtgccgacttgattcacttcatccattccagggccaatttttcactgttgattgtcaggggctctgctctgctgtttctccagccctctccagtgaaagagatgtaactgcagtgccatagttgtcagcttgttagttattggcaagtcttggttggattttctattcttcattgtgggctgtccttgcctgtacacctagcatgctctggaaccctttgtggatttatgagaattcaagaaaaaaaaatagccagggaaatatgttattgctaaccatataggcctcagagtgaaaacggcttttggagtattctgctttgaattatttattttagtctttctcagatgtcaggacagatttttaagatttgggcataatgtttaaaatgaagatggtatgtctgtagattttattgacccaacttggtccccccaggctgtcctcatctgccccactacttagatgaaaccaggaatggcaagaggagagcatccaagccgcctgcaccagccctcagtgcatccccacccaggctctggaacgagctgctacatgcacgggaagaccagagctgccgtcttcctggctgttgttcagagcttatgctttcttagggaaaagtacaatgtagggctatgtgtgtggtggggatcttctgtgtgtgcttgtcctccccctgggaaatgatgagaggtgacccccgagctcccagctcagtgtcacactcgagtgaacagtagatgatgcttctgccatgcgttttgctggggaaggtaacagccatcgcacacatgtaaattcttgtgtaatccaattcctgtctttgtaattacttggagacttgccatcgcagccaattgagaagtgggagcagtgaccctgggcagaaagcagaaattggagaggaggggaggggcggggaggtggcatccagaacacagttgtagctctcctggctttacagcatctaaaatcacttcaggatcaggaaaaagcaaaaacattataactgccctccacgcaagtaccccagcttttctgtcccaagttcccactccctctacctctctcttagcaggctggaggaattctcagcaagcgtgatagagtcaggtcatccgtgacttagctgagaggaaggacttttactgataagaaactcccattgtctggcaacaggtttctgtagaggaatgtcttccaggtgggagaagaatggctttcatttttaacaaccacacactataaacaaagcatcccgagagcacgggtacctagcagaagaagaacgaagtagccaggaaacaagttgcttttcagcatccccactgaaatgatagggtactttagaaagcgggtggtggcattctttccacaagtacagcaagtgtcactgtggggtcttaattctctcgaatctgcctttagaaggcagaaggcagaatgatcagctctgctctgaatgtgtttgccatttgattgacgtcggaaacatgatgtcacttctgcaaacacccacgtgagaaggtgtattttttttttttcttatttgggtgacagattgcatgttagggcactaaaagatgaaagcactaaatacttgctttagaaaaacacagtggaagattctctcatcctccccgctgaaaatttatgggcttagaattccatgaaccaaaatgactgtcttcagttaaacttattgcgaccctctgggcatgattaacaaatcaggtggaaagggaaggtggaggagtatacgggattcttttttcatgttgtgtggaatagggcactttagttgaaattgaggttcaagttagcaaaaagaaattccatccttcggctgggcgtggtggctcacgcctgtaatcccagcattttgggaggctgacgcaggtggatcacctgaggtcgggagttcgagaccagcctgaccaacatggagaaacctcatttccactaaaaatataaaattaggcaggcgtggtggcgtttgcctgtaatcccagctactcgggaggctgaggcaggagaattgcttgaaccagggaggaggaggttgtggtgagctgagatcgcgccattgcactccaggctgagtgacaagagcgaaactccgtctcaaggggggaaaaaatccatccttcttcaatgtgtatcttatccttctcagtgtttaataggacgttctactcaatggattggtttcctccctataaaaaggagcattttgttattccctctttcagatttaatgataaagtcataattcctgcaagccttttgaggaggatatatcttatctcataagatagctgggcacagttgttcaggcctatattgtcagggctttgggaggcctcaaggatcgcttgaaggcaggagtttgagaccagcttgggcaacatagcaagaccccatctctacaaaaaattaaaaagttatccaggcatggtggtgcatacctgtagtcccagctacttgggaggccgaggcaagagaatttcttgagtctaggagttcgaggctgcagtgagctctaattgagccactgcactccagcttgggtggcagaacgaaaccttgcctcttgaaaaaagaagagaggggctgggcgcggtggctcacgcctgtaatcccagcactttgggaggttgaggtgggcggatcacaaggtcaggagatcgagatcatcctggctaacacagtgaaactctgtctctactaaaaaatacaaaaaattagctgggcatggtggcggccgcctgtagtcccagctacttgggaggctgaggcaggagaatggcgtgaacccaggacggggagcttgcagtgagccgagattgtgccactgcactccagcctgggcgacagagcgagactccgtctcaaaaaaaaaaaaaaaaaaaaaaaaaagagaggtgtggtggctcatgcctataatcccagcactttgggaggccaaggcgggtggattgcctgagctcaggagtttgagaccagcctgggcaacatagtgaaaccccatctctactaaaatacaaaaaattagccgggcgtggtggtgtacgcctgtagtcccagctactcgggaggcaggaggcggaggttgcagtgagccaagattgcaccactgcactccagcctgggtgacagagcgtgactccatcaaaaaaaaaaaaaaaaaaaaaaaaaaaagtgagaaagaatgtggttttggtactcagtgtctaggacgtctgtttaatgggatggttaggagcgtgtgctctgtactctgagctcaaaccttggctttgcctctgaccagctgaatgaccatgtgcaactcactgtttatgcctaagttttcacatcataaaaccaggacattattttgcctatctttacttattagtagatttgaatgaattacagtatataaggcaagtgacatacatggaaactggcaaacatctgttttttgttgttgttgtttgtttgtttttttttttttttgagacagagtctcgctctgtcgccgaggctggagtgcattggtgcaatctctgctcactgcaacctccacctcctgggttcaagtgattctcctgcctcagcctcccgagtagctaggattacacgtgcccaccatcatgcccagctaattttttgtatttttagtagagatggggtttcaccgtgttggccagggtggtcttgaactcccgacctcaggtgatctgtcttcctcggcccctctaagtactgggattacaggcatgagcacctggccatatctgtattttttaattcacttctttgatttgggaggaaagaaacctgaaccctcttcttagtgggagtgggataggctttaatgttaatactatgcatcatgtattaaaaatccactatccttctggcactggattaagcttttcataagtattattgtttcacccttacagctgccacagaagagaaaaaccaatattatttaaagtttatgtataaataagctagtcgctaacatgtactcagcacttactgtataccaggctctgccttaagtggttttcatatattaactcatttaatctgctcaatttgtgggaaccattttttctcattttatagagaggaaactggtgcagactttttttttctttttaataatttgtccttggttccactgaaagtaattgttaggactgggatttgaaggctgggtcttcaaatgttgtccaaacgaggctgcccacctccccatcaatgacaaccttctgtcctgtaatgtggaagtgggcccagctgtatgagaagctcagagcacacagatgctgtccagatatgctggcttctgatccttgcagagaaaaaatctttattaccggaagttgtggcttctgagcctctctgcaattggcaacatagatttttgttttgttttgttttgtgtgtgtggttttgttttttaaataattagaaacagttctacaattgttaccacccacagtaaaaaattgcttggatcccgcgaagtaagaaagaaaaaaaaataggccatttggtagaatgattaacagggggctttaaagaggaaagtctgctttggagggtgagctttggatgtacagatgctgggaccctcgtgtttttcaagtcccccatttgcctgcattgagaatcaaatgtgaatggtggttgccagtgataggaggggttacaatgcgtgagatggctctgggaggaaactcacattttttcgtacttattaatggtatgtcttttgtgcgagtgggtgtgagtactgagagcatcaagtgtatatttgcacagtgtgtggtccttgctgctgtgttccactccccatgatggtgggctacactaggaggagaagcaagccttagcacagcttgacagtttccattatatggacagagtcactgaggcaggagcaagccaggcctttttccaggtcaagggagctgggtcagtgtagctgggactcttggtttcttagcactgtgctctgactatcaaagctacgcccccacttttgtgggaataaaatcggtgcccttgcatataagttgttcgcttcactcccagccccctcctgagaattaggatgggccaggatctgagttcagtgcctttggtccagtaagatgtgctattcattggcgatccttcccccatagtttcaagactgtaagtggtcacatgggcaaagagatgatttcctaatcctcgtgggagcttgaaggatttgcctttgttaaaggaggaacatcacgctggaggggtgtctgtctatgtgtcccacttaaaccacactgcttttgacttctcctctgtgatgattcccaggcagcctcctcttgccatcctgacttgtttaaatttatgggttgttggcaagcaattttttgatgctattcttctcatagccagaggccaagatcccttgtggagcagtgcctgaatttaatagatgtcatctggacaccagggaggggcattgagaagcactgggggaaaagtcttagaagtgagattttacccctaacgccgtctcccagcctcttatttatccttttcagggcaatgcagcctgtgatttttttggtggtaccatagtgtcatataccatactctacaattctaggacaaaggacacagtgtcctaatggtcttgcagatggcctaaaatacatatggtaagccacttatttaatttgatctcaaatatctcagcattactgagctctacacctgg

SEQ ID NO: 12467 - DNA, 68610 bp, Homo sapiens
  misc_feature (1)...(68610): n = A,T,C or G, or insertion/deletion polymorphism (see Tables 1-2)
tcgggaggctgaggcaggagaatttcttgaacccaggaggcgaaggctgcagtgagctgagatagagccactgcactccagccagtttgggcgacagtgagactccgtcttaaaaaaaaaaaaaaaaaaaaaaaaaaaaaaaaagacggagaggtgctgtacaccttaagaaagagtcccccttagaagcagttctcccatttggtcggctggatcccagacacttgattttccacgccctcttccctgggacttctgcgatcacaagcagaagagggcagatggcattttaataatatagtaattccatcagaaaaaacatgtgacttagtactactaatctgacaggcagaaatgtagggaattgtactcaatgaatttaaccaacttctctccatttagtaccaattacacttcattcaaccagagaggactacaaaaaaaaaacgagtaaatttaagagcttactgtaaaccacttcatttcgaagaaaccttcctaaaacacttagaagttattttccaaaagatttatattttataaattcaacaaaggttcttcttttcctttagaaagctcttaggtttaagataacagtttgcatatgattactacttttttttaaatctccaagagtttacatgagaatgctagtagttcagtcctgaatgaaaacagagaaagagagaaaggaactccaaatttagctacatcagaaagctagaaaacactgtttcagtgcacacactgggcagattgcgcacattaaaacccactcccctagatcgcgcccaccgcactccagcctgggaaacagagcaagactccgtctcaagaaaaaaaaaaaaaccactccccagcagcctctgcattcattacatgttatgctaacatactggatttatgttaaactctacaaactgaaagctttgatagtaggggaatgtgtaggttattattaattcaagttctgttttttttttattaccaaccacatgccagacacaagtgatgcactagaaatgcaagcacaagacaccagctctgtcctcaaggaatgggcagtgtggctatttaagtgctggcacctgccagtcgtctgaatggggagcatgcttttagggacagtgctagggactggtggagaacacagccacactgtggtctgcctgccacctcctggacctctccacacccgcagaggcctttggcctcttttctttcccacccacattcacaccctgggtgacctcatctgatgtgacctccagtctatctccagcccaggcttattcttttagctccaaacctgtagacccaaaagcccactggacactgctctacaaggatgtctaacatccacctcacattcaacacacataaatccaaactcgcaacagaaagcttcccaccagacaggacctccccaagtcttccccatctgagtttctttttttttttttttttgagacagagtctcgctctgtcgcccaggctggagtgcagtggcgcagtcttggctcactgcaagctccgcctcccgggttcacgccattctcctgcctcagcctcctgcgtagctgggatcacaggcgcccgccactatgcccggctaattttttgtatttttagtagcgacggggtttcaccgtgttagccaggatggtctcgatctcctgaccttgtgatccgcccacctaggcctctcaaagtgctgggattacaggcgtgagccaccacgccccgcccccctccatctgagttgcttagctcaggccatacactatggggccatctttaactcctcccctctctacccatccctctcccaacttccaatctacaaacaaattctattgtctcaacctccaaaacacatgcagaagtcaacctcttacccaccctgagctaatccactggcatctccttgctggcttgttcaacagtctcttagctggtctcgttgcctctgcccttgcccctctgcagtacattctcaaaagagatgccagagcaagcctgttgaacacagtctatcatgtgactcctcctctagaatgaaaccttccaaacggctgccatcctgttcagaataaacactgagtcctcactatgagctgccatcctgttcagaataaacaccgagtcctcactatgagctggcaaggccccactacactgagcctaagtcacctttctatcctcagctcctgcttctcccaccgccacccgctgcacccgagccacaccaggctcttgctacctgcccttcctcctacactgctttaagtcttcgtcaaaacttaaaccttcagagtgagacccttcctggccatcctggctacaattccaatcctcctcatccttggcccaaatcaccatcccccaggagccacgcacttcgctgctaatgctggtctcatgtctagaacgttagctaccccagggcaatggttttcatctatgttgttacttctctagtcctagtgtctagaacaatgcctaacacatatctgacagtcagtaacaaacagtgtattgaattaatgactatcagaacagaaactgtattacacatggtcaaggaaggcagaatcttcaagaactctagagatcaaaggagggcagatcattaatcatctctgaaaggaaatacagcatcaagtcagaaggaaaattccccatgatatcctacaaacatcatatacgtttttatcagcataaacagagacctttaaatgcaaacaccttttctactctgatcccacatgcagcagcatccagtgtcctattaaagtatcaccatgtcaacacagttgtcaagggaaaataaaagataaaataaagtatcgccatgtaacaacataactgttctcccaacttgaacatgatgattttcacattttaggtcatatgatcgacactgaaccgtgtttttgaccttagccaagtctctcatatgatactccagcctcaaggtatcgaaatgatagaggcaggaggcagacaaatcctaggcagagaggggtgggtcaccagtgaaacccaaccttcaagccacagtttaaagcctgaaagccaagcgacgagtctcggataaatccacagactggattgcgaacctctcttcctgtttggtgcgctttcctctaattaatccccacccttcacctattttacatatacctacttttctctaattggtttattacactgttgtgcccacctttgagtagtgactttgttttaaccttttttgcatactcacagacaaatcagcacacactccccattctgagcctataaaagccctggacccagccacaccaagggagaccacccgactttgggtggaagaccacccttgagtcccctctctgctgaggggtgtttcatcactcaataaaactattctccaccctcctcacccttcgattgtcagtgttaagtgtagtctcattcttcttggacgtgggacaagaactagggacccaatgaatgcaagtacaaagaaggctgtaacactgtggccctgggccctctgccggcaaagggcagccacccactgtgacaccccacgtgacaggaggcagcaaagggaagcagcggggacggagccagccccagagctatagcctggagcagggcaatgggagtaacagggctgctgacactctgcaacaccccctcttgggcttcagggttgtaagcacccctgcttgggcgccactaccttccccttgtctggacaccagaatccactgtccctttgtctggacgctggagtccgccgtgggagttgcttgccacatgtctagctgtaagctctgcagagcccactctgctgcctgcgcttgaaacagctggcgggacccggcactcactcacccacacacccactcccgccaggggctgagcatacagtcatggtggccatggtatccgtgccatagtgcaaaccaggtgcccaccggtggaccaagtagatggggtatctcctgcggcgagcctggacccaagcaaggcctgggcaggggcctcgccagccggaggtctctggctgccagagtggctgagaaaaatcctgcatcacaaacaataacacctaaaaagatataatacaacagttgtaaaatagtaaacaacaaatagtacacagctgcaaatagttcaaccgtgaatgacggttattctaaaagacaaacttcacaagatatacacctggtcaacatgctccttagggagtcagggctcctgtttcctccagccacctaccacatttaagtggtgagctgctacaaatcattttaatagatattggcaatacacattacagttttccaactcagatcttaataaatttatgttgtagctaccagaaaaataaaaagtaaaaacaatcccattcagaatgacagaattaaaccagatgaaaatctttctttacagatgggggatacttggtaaaaggcaaatcagttcctacaaagaatgaatgagctaaaacttctgtgtaaaaatatttctagggctactgggctagcgatgggtttggcgctgacttaaaataatcttgctagcaaaaatggagcggaagcatgaaaggataggaaaaaaaccaacactccctatacacacacacacacactccttctctttctctctctcttaggaccccaagaaactaagacccgatgatacaaattcactgtttctctttctcgtcacggaaaagcagcttggagaatctactggttactaaattgaagacaaaaacaaaaaagatacgtatactgtgatgaacacgtcacgtttctctcctccaacctaccaataacttcataaaagttaaagagcttccatcccttcacgctcagctgcggaaaggctacgctttcgcccgccgctcgcgtccccggcccggaccgcggccgccccgttcgccgccgcgcctctccccgcccggcaggctccgccgccctccacggccgacctggcgcaagggcctgtgcagccacaacctccggagcgctccggacgggaccggaaaagcagaagctccagcgcaaccgacggcgggttccgcggcgcagtgcgccgccgtccccctcccgctcccaccgcccaccacccaccaacaccgccccgcgctcccgcagcgcccgccgccccggcccagcctggcccgcaccggcgtgccccgaggcgagtcgcggcagcccgacccgagcaggggaggccaatgataaggcgagcacctcctgcggaaagaccgacccccggcaactcctcacctgcgtccatcttcccagtccggccgccgactgacccgagcggcgtcgctccgacgggccagcaacgcgacgcggcgacgggacgccgcgggggccaataggtgtgccggcgcaggcggcgaagacgatacggcgcgcgagcggaaatacgcgggagccgccattttggcgtacggccgggccgacgcgagccccggggcgccctgcgggcggcatggggtcgtgtcgtgggacgacggctggttctgctgtccgacgggacactgtgtgccatgggtggcgcttcctcctcttagaggacccaggagcagttgtcgaggcggcagaggcgagctctgtccccgtccgagcagccatcttgcggtacggacgtgctcggcgcgcccatgtcgcggtacggacttgccccgccggggcgactcccccgcccgtctgcccgcctgccgacggacgctgcgaggggcctgcggcgccccgctggtccgaagacgcccgaacccgcggctggcgaggacgcgggcgggggatggggcgggggcgggcccgctgcgggcgcctgcgcctccatcttgccgtacggcgcggacgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggtcgtgaactgctccaaccggcagggaaagggcgagaagcgcgccgtctccttccacaggtacgcgggccccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggcgcctagcttcagaaagccgcacgctctggtaacgcaggtcctgggccgattgtcctgctcggccgcgactgctgactctccggaccgcgcgggccgtcggcctggatgtctgcgagcaggagcgaccgggcagacgcgacctgcgcctccgtagctgacagcccccgagagggctttccgggactgggcccccgagcccaggacgcgggtacgcgcggagagtctacgggacggccggctggggacggcatcctcctgcgctcccttagagcctggcccggggctctcggccgcttcccacgtgggcccccgcggcagggcccaaacccctctaaggccttgtgagttcagcctatttcagtgagatttctgcggattacacgcgggaggcaccagaaccgcgaacagactttaaaaaccactttggagatgtttctgttttatgttgcatggtgttatttaagttttaaagacgggaatggcacgtgttatttatagggttattgaaagttcacagtagtttgctgtaagtcttaaatcattacaatgtattataagaattagtaacattagattatttcacaagtcagccagcgcactttcttgacaatttccttcagagcttgtgtcctagaagttttgttattgttttttgaaaacgaggcaacgtgttgcaacggtctaacatggtatgggaggaaaggacatcggaattgggggtgggggggtacctttgcagttggcctcacagtgttcagaaaggaggttagaaggtcctgttgcttagaacggcccagtccatcctgttaggatttgtcctggtccacactggcctcaggtggagcaaatagcagttagaactgaccaccctgtcccttatgtgcacattagggcctggtttttttttctttttttctcttttttttgagaaggagtctccctctgtcgcccaggctggagtgcattggtgcgatctcggctcactgcaacccccgctcctgggttcaagctattctcctgcttcagcctcccaagtagctgggattacaggcaagcgccaccacgcctgtctaatttttttgtatttttagtagagacagggtttcaccatattggccaggctggtctcgaactctggcctcaaagtcctgacctcaagtgatccacccgcctcggcctcccaaagtgctgggattacaggcataagccaccccgcccggcccaggcctatgttcttaaacacagagtttgccttaatgaagaaatggttatgaaggatctttattaggtaataaagaaatgactaaacatcctattcagtatcttcctgcgctggttgcttttttctcaccatttttaaattatggtataatacatgtaacatgaaatttaccatcctaactttttttggagacagagtcccactctgtcacccaggctggagtgcaatggtatgaccgtagctcactgcagcctcagcctcctggacccaagtggtcctcccatctcagcctccagagtagctgggatcacaggcatgagccacggctcccagcctttcctaccgctttttcagtgtacaattcatggcaacaaatacattcacgttgttgtgcagctgtcactaccatccacctccagaattatttttattttgtaaagcggaatctctggactcattaaacattaataccccagtcctcctctccctaggctctgggaacccgcattctcctgtctctatgaatttgattactctgagtacctcatgtgagtggtatcatgcagtgtttgttttttkgcacctgccctatttcattcagtataatgtcctcaaggatcatctgagttggttgattttttttgaggggagaagaccgggtttcactctgttccccaggatggggagcagtggtgcagtcttagctcactgtaacttcgaatttctgggctcaaagaaccctcaagcctcaggctcccaagtaactggaactgcaggtgagcaccattgtgccctgtccctgggctggttgacttttaaaaggagcatttttactcctggaggtgggcatgcaacaggaacacagaactgtagctctggagtcttctggaggtctccagattctcagctgcttgcgcacagccagggctgcctccatgcagtcctgacctctcacgccctagtgtctgtggatgctggccctggttttggtacccagagtcctaccttccaggcaagttgggagggttggttagcagtcagcttctaggagctatttcctgctgtcctgaggccatcctggcactgtctgtcagcatcctgtgtccccattgggcatttaccacagcctggggagcagttggttaccttctttcccatccgccctacagactataagctctgtatgggtagacaacgggtctttcagatttctactccagtaataactgcaggtagaagatgttctttaaatctttttgaagtatttttttaagtggatgaagtcaatacggcttagggtgcgtgcaaaaatacttgttttgcttttacagttgattattttaaggggagacatttaattatttctaattactttttgtcatttgtcctgtaggttcccccyaaaggactcamaacgtctaatccaatggttaaaagctgttcagagggataactggactcccactaagtattcatttctctgtagtgagcatttcaccaaagacagcttctccaagaggctggaggaccagcatcgcctgctgaagccyacggccgtgccatccatcttccacctgaccgagaagaagaggggggctggaggccatggccgcacccggagaaaagatgccagcaaggccacagggggtgtgaggggacactcgagtgccgccaccrgcagaggagctgcaggttggtcaccgtcctcgagtggaaacccgatggccaagccrgagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctcyaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcracaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcggtcagtaccggagcctcgcgtacccatgttcccttcccgttaggaggggtttctctgcaaggtggccagygtcccctgagcatttctgggaggtgtcacaagctccctgcgctctcaggaggaagctctggtcgtaaccataccttgtggatgagggaatccaggttagaaagcaggcctcactgcacctggtcccacaagaggcatctgtgtgtgtagggatgtaggccgtgaaggaggcaggcagcacgcgtcagccaggagtgcctgaacgcctccgtggagagtgcacagggaaagatagcttctgtttcataccttatgcaacagaaattccagatgagttaggaactagatggaaaataagagagtaaactctcagaaaaagcaaatatcagaaactgttaaaatcatgaggaggttctttctgttcacgttttaaggaatatccttgaagttaaatcatcatgaacaktaataattattttaacatcyattcaattaaaacatctgttgaggctggactcggtggctcacacctgtaatcccagtactttgggaggctaaggtgggcagatcacttgaggtcaggagttcgagaccaccctggccaatatggtgaaacatacaaaaacatactactaaaacatacaaaaactagctgcacatggtggtgcacgcttgtaatcccagttattggggaggctggggcaggtggattgcttgaacctgggaggcagaggttgctgtgagccaggattgcaccacttcactctggcctgggtgacagaataagactctgtctccaaaaaaaaaagacacacatctattgaaacacattctcagccgggcatggtggcacactcctgtaatgccagctactcaggaggctgaggcaggagaatagcttgaacctgggaggcggaggttgcagtgagctgagatggcatcactgcactactctttgtcagcctgcgtgacaaagagcacaactctgtctcaaaagagaaaaaaaaaaaaaaagaaatacaatacattctctgttgcaaaaattaaaactgcagaaatagactaagaagtggtaaaaaaattattgtttgtcatccacctcccaagttctattccttgttgttattaaaaatttggtgtgtaagccaggcacagtagctcttgcctgtaatctcagcacttcgggaggccraagagggaaggttacttgagtccagaagttcaaaccagcctgggcaacatagggagaccccatctctataaataatttaaaaattagccgagtaccatggtgcacgcctgtggtcccaactacttgggagactgaggcagaaggatagcttgagcctgggaggtcgaggctgtagtgagctgtgattgcaccactgtactccagcctaggtgacagtgagaccctgtctcaaaaaacaaaatttcctgtgtaatctttgtatgtatattagctctatttctgttttttcccrtattttactgttaagtatttcttaaaattggtttctagatgtttacatatggcggatggtttcctttgcctgtcgtgtacataggaaaaccatattcctaccacattgttgatttcatctggatcaatgcttgtcaataagtatatgatagtgggacaagattttcaggacctcctggatcctcagggtaacagctattagcacaaccgaaaacaaagcccatccgacatgttctccagatgtgtcctggggaggaacggtgccactgagtactgctgacctagattttcagatcaaatctagattttcggattcttgggttgaaattgtatactgtttttctcttggaattttattttattttttgagatggcatctcactctgttgccgaggttggagtgcagtggtgagatctcagctaactgcaacctctgcctcccgggttcaagcagttctccaacctctgcctcctgggttcaagcaattctcctacctcagcctcccaaggagctaggattacaggcccctatcaccacacctggctaattcttatatttttagtacagatgatgtttcaccatgttggctacagttgtgagccaccacaccaggccttctctcggaattttttttttttttttttgagacggagttttgctcttgttgcccaggctggagtgcaatggtgcaatcttggctcaccgcaacctccacctcccgggttcaagcaattctcttgcctcagcctcccgagtagctgggatcacaggcatgcgccaccacacccagctaattttgtatttttagtagagacagtggtttctccatgttggtcaggctggtctcgaactcccgacctcaggtgatccacccgcctcggcctcccagcttctcttggaattttaaagctgtttgtagttatcagagctaatgctgctttwgacagcttctctctgttcctcttggttaaacttcctgaagtttgtctccattacaggtttttgcaaacagccagcccttcgtgtctctgagttgttgtttatgctggttaatccttacatctttttgctttgttgggttttttcttgtagttctggttcctggcgtgttccttaaccctgcaatggaggctgtggctctgctgttccttgggctgcgtgccatggatctgcctctctctgcttttgttgctgttcatttctgagtcgtttgtaattccagcctcgatgccccctttaaccctgtggttatttaaaagggtgttgacagatttttcagtgcacacagattgggcgaggggagcaaatttttttgtagttactttaaaatttgattgcattaaggtctaatggtaaggactgaaggagttctgctttttggaatcctttgagacttcactgtggctaacacagtccctttttgtgactgttgcagtgtagtgctagaagaatgtatcctcaccactccttggttatattgttcccgcctgaagctgggcacttgcttacttgtgttagtcagcggaccagagcgttccctagcttcttgtcaggctctcggtctgctgatttccaggaaaggtgaggtagacctcccctgtggttctggaggtgcccgtttctgcttgtatgtccaagttttgctttctgcctcaagaccatgctgtttgatgcataagttttcctgttaccaacacaagaaactcctttttgtcccgtttaacgtcttatttcttcatttccttattttcaaccttttcatcttattttatagttatatttttaactcaatccaaaagtctttttgtagagtaatttagtcatttacaattgtgattactgataagtgggaattcgggcctacctttttaatttgttaggcttcctcaccgttttcttattattcttctagtggatatgtttcaattttttcttttctttttttttttttaagagacagggctttgctctgtcacccaggctggagtgtggtggtcctatcacagctcactgcagccttgacctcctgggctcaagcgatcctcccacctcagcctctcgagtagctgggactacaggcacataccaccacatccggctaatttttaaaattttttgtagcaatagggtcttactatgttgcctgggctggtcttgaacccttggcttcaagggatcttcccgtctcagcctcccaaagctctgggtttataattgtgagccactgtgcccagcccatctttcagttttaaaaacaaacacgtgagcccctctttgtgtaactgttgagagctgatcggtcctgtgtgccaccttccctaggtggaggctgtatgtcatcttagttccggtgcttcttattcccccatcaagcaaccatgattattagattgaagtatacattttactggttactttatttaccattgtttgctgtatccaagtttcccctcctttttggcagtatttaatgactttttttttttttttttttttttgagacaatctcagactggagtgcagtggcatgatctcgtcttactgcggccacgaccccctgggctccagcgatcctctcacctgagcctcctgagtagctgggactacaggcatgtgccatcatgcccggctaattttttgtgtgtttttttgtttttttgttttttttgttttttgtttttttttttgtagagatggggttttgccatgttggccaggtaagccaccgcacccagccatgactttaaaaaaaaaaaatcctattccagtacagttttgaggggggcgctggtgactgttgtggcagtcccagggtagatggcgatggctcagactttagggaggaagtggcggtggtagcaatgctggagtactggctgggttcagggggttgagaggcaaaagatcagcaggccagctacagggattaggcttgagcacctggaggatgctaagtgggagaggcttttggggaggagcaggagatgggggtgaggaacggagtttgagatgctcttgggtgctgaggccagagtttgaacaggcagtctgaggccagcagctggcctctgggatttgggcatgtgagtgtgggggtggagggcaaaggtgtttgaagccttggggggtcgagtgtggttctaggctgggcttcagtgcccggcccaggagcaggcctcgctgagagggggcagccgaggcgggtccaggggaaggctgaggggttgttcaggaaagaagggtgacttgctgtgctgggtgctactctgaccagaatggagagaagggggctggatgtgccccaggatagtggagagaagggggttggatgtgctcccagggtcgctggttactggaatctcactggagaggctggtggagctgggcggagagggggccagtgatgaggggtcagggccaggtttggccgtgaagtggagtgaggcaagtagacaggagccagagggagtgtggctccaaagagagtgtgtcagtggggagggctgtgaagggccaggctctggagagcaagggacaggtgcaggcaccaccctgcatgccttgtgcccctccaaaggtgaggccaggccacggctgggcatgcggtgtgggcacaggggtggcaggagcgagggtgtggtggggagaggacatcctctccctggggttgcagtctgtcacgccggcgtcgcaggccctggggtctgcactctgtggttcttgctgtccgtgtggatttgttcttcagtgacagactctttgggtcattctttagggatttatgtggaaagcgccgcacacttgtctattcagctcgctagccagtgtctgcttttgggcaggttccccaaactgaaggatgcgggccagtgggcttcagaggtgggttgaagccacgctccagaggcagtgcccggtggcgttctgtggacgtagtgttcttctccgccagcagcgattccttgagggtacattgttagcacgtctatgaaccacgtgttcgcggtcttgcttgcccactgagttataaacgttcttgatacagtarggataccaacgcctgttaaatattattcacctgtttcctaagttcagcaatttaacacttgcttcaaaatctgttttctttttrttcctttatggattcattatctacatataattcttgaaatctggattgtcaaaatccaagtacaaaacaagtgaaccttaatgtaaactatggaccctatttgtagcaatgaatcagtattggttcgtaacttgagacacacatacccacactaatgcaagatgttaatcataggggaacagggcagggggtgagagggtgaaggaattctctgtactacctgctggatttttctgtcctaaaaacaatctgttaataaataataaatggaagctgaagagtttggagaagtgcagacaaaacaggaatgtcagaagagtgataaatggtgaaactagggacatgtgtgtggatttattacactaatctgtttaatttgtaatgttcaagatttttcacaatataaagttgttcaaaaatccagattagctgggctcagtgactcatgcctgtaatcccaacactttgggaggccgaggcaggcagatcacttaaggtcaagagtttgagaccagcctggccaacagggtgaagccctgtctctactaaaaatacaaaaattagctgggcatggtgacacgtgcctgtaatcccagcttctcaggaggctgaggcaggaggatcacttgaacccgggaggtggaggttgcagtgagtcgagatcacgccactgcactccatcctgggtgacagagcgagactccgtctaaaaaaaaaaaacaaaaactgttaagaaatagcagaaataataacagtgttttttttcctccttatgatgtgagctgtagtactttgttgttgttttttggtttttgtttttttgttttgttttgtttttgtttttgttttgagacgtagtttcgctcttgttgcccaggctagagtgcaatggcgatatctaggctcactgcaacctccgactccctggttaaagcaattctcctgcctcagcctcccaagtagctgggattacaggcatgtgccaccatgtccagctaatttttgtatttttagtagagatgggatttcaccatgttggccaggctggtctcgatctcctgacctcatgatctgcccgcctcagcctcccaaagtgctgggattacaggcgtgagccaccaagctgtagtttttttatatgtcctttatcaagttgacagaattcccatttattcctgttgctgagagctgttatcatgaatgggatgttggaatgtgtcagatgatttttttgcacctattaatgtgatcctgtgatttacggtcagatgatttgcctgttgatgtgacgggttacgttaatcaattttagagcacagagccagccttgcatacctggaatagatctcactgggtcatggcaaataattctttttatacattttttttattcaatcgcaaatgttttcttagagatttttgcatctgtgttcatgagagatatttgtctgtagttttcttttttctttttttttttttttttttttttttttagagacggagtcttgctctgttgcccaggctggagtgcagtggcacgatctcagctcactgcaaaaaccacctcccgggttcaagcaattctcctgcctcagcctccctagtagctgggaccacaggcgcccgccatgacgcccggctaattttttgtattttttagtagagacgggatttcactgtgttagccatggatggtctcgatctcctgacctcgtgatctgcctgcctcaccctcccaaaatgctgggattacaggcgtgatccacacacctggactctttttcctttttcctttttttttttttttttgagacagtgtctcactctgtcacccaggctggagtgcatagtacagaggtgtgacctcggctcactgctgcctcaacctcctcggctcaggtgacccacctgccacagcctttcgagtagctgggactatggacacgtgccgtcacactggctagttttttaatatttttgtacagacagggtcccagcctgttgcccaggctggtctcgaactcctgggtccaagtgattctcccagcttggcctctgaaagtgttgggactacaggtgtgagccaccacacccggcctgtagttttcttgtagtgtgcgtgttttggtattagggccctgctggacacacagaatgagttaggaagcatttcctctgctactgttttctggtttcatttcttccttgaatgcttggtaaaatccaccaatgaagctagcagggcttggtgctttctgttttggaaagctattaattattccatttctttaatagatgctgtgacataataaaaaaatatatttagtctctgccccagaatatggcccagagctcctaaaacccttgtcgtctcctgagcaaaatggcgctccgaccaccttccgttctcatagtcggtctttgctctgttcgtcatacagagctcctaatcccttggaatgttctaataaagtgattcttggggggctcccagatgagggctgctcaccagaaagaccaagccataaacagaagctaggggctttgagccccaccccctccatcctgcaggaagaggaatggggtagagttaataattgatcatgcctatgtaattaagcctccatgaaaacttcagaactacagaatttggagagcttccaggttggtgaacacatctgtgtgctggatgaggtgatggtgcaccccaactccacagggacagacgccccttgcccgagacccttccagacctctccctgagctcttcctctgactgtttatttgtatcttttttttttttttgagaaagagtctcactgtgttgccaggctggagtacagtggcgcgatctcggctcattgcaacctctgccccctgggttcaagcgattctcctgcctcagcctcctgagtagctgggagtacaggcacgygccaccacacccagctaattttttgtatttttagtagagactgtgtttcaccttgttagccaggatggtctcgatctcctgacctcgtgatctgcccgcctcagcctcccacagtgctgggattataggcgtgagccaccacgcctggctatttgtgtcttttaaaatatcctttgtaataaattggtattagtaaataaactctttttctgggttctgagagcctcctagcagattatcaaacccagggaaagggctgtgggaagcctggatttgtagccaggtggggcagaggctgtgagtaacctgggacccactacttgccatcgtcctcagatgggggcagtcttgtgggactgagcccttaacctgtgggatgtgcacgaactccagttcgtgtcagaactgaattgacgtgcaggacacccaaatggtatcagagaattggtcagtgtgggaaaagacctgcatgtggccacagaagtgtcctgagtgtgcgtatagagaaagagattgtttttttccatatattcaatataggcctgttcagattatctatttcttcttgtgtgagttttggtggaggtatctttcagagaattggtccatctcatctatatgattaaatttgtgggcatggaagtgtttatgatactgctctattaagcttttaatggccatgggattaacagtgattgaccccctcccttcttttttttttaaatgatatcaataatttgtaccttctytctttttttttttccttttttctttcttgagacagggtcttgctctgacacccaggctgaagggcactggtatgattttggctcaccgcaacctccgcctcctgagctgaggtgatcctcccacttagcctcctaagtaggtgggactacagatgsgtgccaccatgccctgctaatttttgtatgttttgtagagacagggttttgccatgttgcccaagctggtctggaactcctgagctcaagctatctgcctggctcagcctcccaaagtgctgggattacagacgtgagccaccatgctggcctatccctttacttttaatctatgtttttatattcaaagtggggtttttttgttggtggtttatttttattattattattatttttgacagagtctcactgtgtcaccaggctggagtgctgtggtgcaacgttggctcactgcagcctccgactccctggttcaagtgattcaggaggccttagcctcctgagtagctgggattacaggcatgcactaccacacccagctaatttttgtatttttagtagagacggggtttcaccatgttggccagggtggtctcgatctcctgacattgtgatccgcccgcctcggcctcccaaagtgctgggattacagccgtgagccaccgtgcctggcctcaaagtgggtttcttatagtcaacatatattcagggccaggtgaggtggctcacacctgtaatctcagctttgagaggctgaggtgtgaggattgcttgagcccaggagtttgagaccagcctgggcaacatagtgagaccccatctctacaaaaaaaaataagaaaattagctaggcatggtgatgcacacctgtagtcccagcttcacaggaggctgaggtaggaggatcgcttgagccccggaggttgaagctgcagtgagccgtaattatgccactgcactccagcctgggaaacagaacaaaaccctatctcaaaaaaagaaaactttttttttktttgttttctgttaggtcaattaagaataagaaaagattttattttaccttcacttacttctctctgatgctctccctttttttacatacattttagtttctgacgtatatcatattccttctccctgaagaacttttaatatttctcaaagggaagaggtactgccagtgaattctctgtttttatttaaagaaatttttttgtttgttttttgttttgttttgtttgagacagagccttgctctgtcgccaggctggggtgcagtggcgtgatcatctcagctcattgcaacctccacctcccakgctcaagcaattctcctgcctcagccttctaagtagctgggatcacaggcgcccgccaccagccccagtgtcgtatttttagtagagacagggattcaccacgttggccagactggtctcgaactcctgacctcaggcgatccacccgccttggcctcccaaagtgttgggattacaggcgtgagccaccgygcccgcgtaaataagtctttatattgagtttctttttcagagatttagaaaaaaatgggaaaaaagtaagttctttacttctcctttgcacccgaagaatagtttcactggatgtagagttgcacgtttttggtttggtttggtttttttttttgcttgcgtggtttctgacaagtctgctgtaattcttattctttctgctctacatgtaaggattttttttccttttgattctcttagtctttggttttctgcagtttgagtatgacatgcctatgtgtagattctttggtatttatcttgcttgatgttttccgagcttcctggatctgtggtttggtgtcatcgataattttggaaaactctgaactatggttaattcaaatacttctgctcctttyatctctttctggcattcccattatgctcatgtaacacttttgccccacaattctccaatattctgattttttttttccgtttttttctctttgcatttcagtttgggaagtttctattgacatatcttcaactcagtgattctttcttcagccatatccatcctattgatgagcccttagagattcttcatttcagttagcatttttggtttgcagcaatttcctttttgttcttttgtccatcactcctcttacattgcccatgttttcttgcctatcacccactttttccrttagagcccttagcatattaattgtactgattttattattattactattattttgagatggagtcttgctctgttgcccaggctggagtgcagtggcacagtctcggctcactgcaacctctgcttcctgggctcaagcaattctcctacctcagcctcccgagtagatgggattacaggcacccgccaccacgcccagctaatttttgtatttttagtagagatggggtttcaccatgttggccaggctggtctcgaactcctgacctcaagtgatccacccaccttggcctcccaaagtgctgggattacagaggtgagccactgtccccaaactaaccagtaattttaatttctccgtgtggtaattctaaaatctctgccgtacctgagtctggttctgatgctcactctctctcttcagatttttttttttgccttttagcatgtctcgttatttttggttgcaaagtagacatgaaatatcagatccagccgtgtgctacatgatgatgttttggtcaatgacagaccacatacaccatggtagtcccgtaagaattataatggagctgaaagagtcctgtcacctagtgacattgtagccattgtaacatcgtagtacaattttttttaatcgatttagtgtagcctctgtgcagtattgagaaagtctaccatagtgtacagtcatggtcccaggcctttgcattcactcaccgccggagtcactgcctcagtcaccgactcactcacccctcactcactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgactcacaactcactcacccctcactcacgactcacgcacccctcactcaccgactcactcacccctcactcaccgactcactcacccctcactcacccctcaccgactcactcacccttcactcaccgactcactcacccctcacccctcacttaccaacttactcaccaactcacccagagcaactgcccatgctgcacactccagtgctggtaagtgccttatgcaggtgaaccattttttgtctcttatgccatatttttactgtaggttttctatgtttagatgtgttttaggtacacacacccttggcactgtgttacaactgcctacagtattcagtaacacactggggtgtgtagcctgggagcacaggctgtgccatacagcctaggtgcgtggtacgcggtaagtgcactctgtgacgtttgtacaatgatgaacttgcctcatgacgtgtttgtcaacrcatcccccatcagtaagtgctgcttgactgaaaggtgaagtaagtgtgccttgtttggagggcatccatccccttaacctggctggcactcgggctgtgtttaatcctgcagtggctgtaaaattcctcgagtgtccttgttttgtctccctgttgtcgtggagtttctccgagcatgccttccacagcctgcgcctgggccctttccactcccacccaggatgttatgctggagcctgcagggctgggaggggaagcaggctccagcctgtgactcgatttaagcccttcagtggcccgtgtccctgagccgtgaccttcacacgtgtctttccctttctcctccccgcttgggtgagacggaagactggtggggctggagcagtgaaatgcccttcccagctgagatgaggtcctggtgaagtcagcttcgctacagagcaggcctggcctttgcctggagaacgctctgggctcatttcaaggtggtcacctccccctcctcatcccagagacatgaggtgtttttttttttcttggcttttcgtggggagaacctgatggggttcctggaggtgaaacctatgaaaatgtaggaccccaggagattctcacacctgccatgttcagcctccagcattttgtccaaatcaagttcccaccagttccttcccctgtagactgtagattctgctccacgtgagctgatctcactgctattctctgtggcaggagagacatctgtgacctcacttccttatggatccaagaaaagttgttgatttttcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgattctaatagttcttcaattgatactcagattaacgagggaaatcaaacataacatttgcaaattatttgtatccactttatggcctttttatattttatagaaatacttgctgtattttctctccatcatgatttctgtttttcccctgggcatgcaactccttccgtttcatggttgataagttgagggccttgatgtcactttaaaacaacagttccctgctggtatgccttgtcagtggacccaaacatatcacggtgttcctggacagctcctccccaccttgggacagctggtgcgggccgcgcaccctcagcttccatgcaccctgttgtactaagcagtaagtgtccctttctgtgtgtgccttggcaggaaacaccgtgtcactaacacaaagagatgtgagggtgggagctccaggaaggagccgtccccaggtcccagtgggtgcatttgctcacttcctgtcctgggttcccgggccgcttgccaggagacaggacagtctctggagcctccatgtccaggtgaagatgagtctccagccaccctctaggagacagaaaaggacatgccaggggtggccagagggactgctctggagagagaaagcatttaggatgtgcctgkytctgtggtgttgccttcctctgctgtagctggtggaggaggctgagggtagaagccgcactcgtcactccgcccagacctctggccagtccctctttcataaaattcacctaacctccaaagctccttccagctctgaaattctgtgatstgggctgtyattgtcttttactttcttctgagacgtgatctttcatagtggaactacaattcccagaatgcaccatttaaagttagcattcacttcctgcagagccattaagagccaggtgcaaacatttcccgtcaattggcagaaaacaaccttgaggaaccttgacgagtgtccggagtttagaaaacttagggatgggtaagcctgctttcagtgtcttgggccaaaacatgaaaatttaaatttcttgcaggaaatttaaatttttgtttttgtgttttggttgagatttyaataaaagaaaaatgaaatcagaaaagaaatgcctasaaaagcctgtctggtttatttaaagaggtggaaagtgacaaatagactaggtcctttatagtattttttgtttcatgtttaaatttatttttttctaatgaagtataatttacagagagtaaaatacacagatattgaggtcacagtttgatggatcttaacatatatctaggctcaagtaacctgatgtttggattctaaaattctcttactggtcgtcctcacccccacccatgcttcagtgacaacaaggagggacagtggctaggctgctgccacgttccacgcggcccgaagtggtggagggtgcagggggagcggccccaggagcaggttaacctggtgaggtgcagygtagacagaaggaggcgccgccgctgcttgtttactgcctgacctgttgtccctgtccaaattaaactccattaagattcagagcaaataacagcaagccaggagggcgacaggaagggaagtatttctcacagccattagttgctcacagccgtaagcctccatctagttgcttagccgcgtgctccttcctttccagtctgatgttattttttctgctcaaaagcgtttcttctgaatttcagagctatcttagaattctctagttttttaaaaagaaattgccacataagtgctgcgtcctgtcctgtccccaagtgtggtgtgggccctgtgcccctgaagcagcagccgcctgcagggtagcttctctccagggcccgcgggacttgcttccctgacctggcatgcacatagcaaagtccactcaaaagctcacttttagccagaatttttgaggcagcctctccctacctgttcttaccaggacaccatccccctgctcaggtgccactgcttacccgctctgtggtgggcctctctggtcctgatgccagggctcgccctcagctctcgtgcgcctgcacccgcccttctcactgatgtcacgggtcgccttccaagctgccagcaatgccagctgctggccatctccagcccacccatccctcttatctcactctcatttccatctcccttgggctagtcgtcgaggcagaaagcccgggccacgtccctcctacgtaaaaggttctggcccatccaggcccacttgggggaatagatggtccagttcaacttgaccagacttcagataagcccagttcttctgaggagccagctgtgctcacctgtccttgccagccccctgactgagttctcccaggcgtcttgtggcaggggctctgggctgctccagctgcaggactggggcagagtgtgtccccatgggcgccctccttgcttccaggccagccgggctgggcctgtgtctagaaccagctccccagcatcctgaggaacgcgaaacctactcagaaacacggctgagggcggcgaagagctctcctgatgtgtcgggaaccgtgggcttggggcacggggatgtgctgggtggctgccagtggcgtcctcactcccacctgggagaagagaggagtgaagaggagaggtgggaggtgagaggcaccgggcagggcgctgtgtgtggctccagccctctctggccctctgcacctgccccaaggtatgcgactcacamcacagtggtgtcatttgttttaatttgaacagatgtttagaaattgggatattttagcctaaaatcagcttctggcttttctcgaaatattagatctgcagtaggtgctgcagcttggatggcagcagaccctggggccaggagccaaggccctgagctgtgaggccracctcactccccaccacatcccctgctctgaggccacccagaaccctgtgctgcagtaacatagtaaacactcttgggataaaatkcttttagtttttttaagttttctgctttttgaaatattaatttgtttggggaggtttttctttataacatttttattgaggtgtaattcgcataagtgaaacacaagctcctaggtgttcccgtggtgagttttggcaggtgcaggcgcttgtgcagccacacccacgtccagcggtccaggttctcctttgcactcccctccaagcccctccccgtcaccgttcagattccccaccctccatcctttctgcctggtctcgaatttcatctaattggaatcatagaatatatacgtttttgtctggcttctttcttttcgcgcagtgttttcaagggacacctgattgattttcatttctagtctcactgcattgtgatcagacagtagacttctttctgctttctggaacttacaggctttctttgaccatttagaaggccagtttgcatgactgttccagaggaacttgaagaaggcattccttagttttgtttttgtttttgtttttgtttttgttttgagatggagtttcgctcttgtcacccaggctggagtgcaatggtgcaatctcggctcaccgcaacctctgcctcccagtttcaagcgattctcctgcctcagcctcccgagtagctgagattacaggcatgcaccaccacacccggctaattttttgtgtgtttttagtagagacggggtttcatcatgttggtcaggctggtctcgaactcctgacctcaggtgatccacccacttcagcctcccaaagtgctgggattacagtcgtgagccactgcgcccggcggtattccctagttttaagctacagagttcaatatgtatcagtcagaactaccttattaattatattatttgggaattttgttttatttgtattcattcagacttagaggtgaattgcaatttcatttagtttctttctctcgacatcttcgtgtgtcatcagtaatttctgctttatagatgttgctgtgcttggtgcatgagtatccctcacggttacgtcttcattgtgcattctgcccttcattcgggagagccattctttgtctagttccatgcattttacgtgatgctaagattgggaagcctgcttccttattgcttattgcccagctttctggactctctctctgaattgctttattttaggtgcatctctcatttacagcaaaagaggtgagggtcttgctttgtggtccaatctgaaaagcctttttttttttttttctcaaggcagggtgtctctccagttgcccagactggagtgcagtggcgcgatcttggctcactgcagcctcaacctcctgggcgcaagtgattctccccacctaccctcccaagtagcgggggctacagacacgcaccaccatgcctggctaatttttttgtatttctggtagagatggggtttcactatgttgcccaggctggtctcgaatttctggactcaagcaatccacccacctcggtctctcaaagttatgggattataggtatgagccatcatgcccggccttgaaaagctttttcatatgtaagttcaagcatttttagtcttggttctgtcatcttattttatattatgcttgttgtgttttacttttttttgttttgtttttgttttgtttctgagacagggtctcgctctgtcacccaggttggagtgtagtgatgtgctctcggctcattgcgatctctgcctcccaggcccaagcgatcctcccasctcagcctcctgagtagctgggacgacaggcacgtgccaccacgcccagccaattttttgtagttctggtagagacagtgttttgctatgttgcctgggctggtctcaaactcctgagctcaggcaatccaccctcctcggcctcccaaagggctgggattacagatatgagccactgcaaccggcccagtttttaaaatgaaatcttccactgctacttcatttgtaagcctctgtggtgtcagctctcagggacaagaccagtggggagttctgccccttcaagggtcctatgagttgagtgtcatgcctgtacgaccaggcatctaccacctataaccagtttttttttgttgtttctataaccgctttttttttttttttggcttagtacattcagtgtttacggaggtttctttccgcatcatttccctattgtctcctgatgacatccagctgctggtaatgtcctcagggagaagacatagaaacaaagctccttgggtgccaagggttgaaaactccattcctgcactgtcgaaaaggtctagagagtgagtctcttatgtagtttaatattttctaatagctacattaaaaaggtaaaaagaaacaagtgaaatcgattttaataatatattttatttaacccgatattatctaaaaattatttcaacaggcaaccacccatactataagattattgaattatttgaagactttttggactgagttttcggaatctagtttgtagctcgcactcactgcacgtgtcagtgagccagctcacgcgcctgcaatctggaaggatcgctgtggccagccgtagcatccttgccactcaccttccctcctcatgcgccttctacgtgtgactctagcgtcttctgccacagaacgcagctgtggagaaacactgacccacgttctgtctctgtagatgtgtgtgttctgcacctttcacagaaatggaattgcagaatatgtgctcttttgagcctgattgctttcatatggtgtgttgtcaagggccatttgaattgcagcttatattagtgcttcatttttatggccaaataacattccattgtctggatatactgcagtttgtttactcattggttgacggacatctgtgttgtttccactttggggctgttgggaatggtgctgctgtaaacattcatgggcagcgtcctgtggggacaggtgtgtcatttctgctgggwrtgcatgtctccaggagtggcagtcctgggccactgctccacacttaacctctcaggcacatgccagatggtcttcactaggctgtgccagttcacgtccccatcagcagtgtgccaggcgttcccgtccttctaactttgtttccatttctctatcttttgtctttttttttaactcatttctgtcctctgtgttccgctgtgtttcccggtgtttgtttctccctgtgctgcttccaatctccacttcatttgggtggtggcttgattttttttcttttactttctcgacttctgccaggtcatgtttcaccttctcctctttccttgccgtttctctcctgagttcttacatgtttagttagtggtctttcttcatggagcagcttcattcaactactcgggaggctgaggcgggagaatcacttgagccccagtggtctaggccgcagtgaaccgtattcatgccactgcactccagcctgggtgactgagcaagaccctttctcttagtttcacctttgccccatcaacattttgcagtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctcactgcaacctgtgcctccggggttcatgccattctcctgcctcagcctccctagtagctggtactacaggcacccgccaccacgcccggctagttttttatatttttagtagagatgggatttcaccatgttggccaggctggtctcgaactcctgacctcagatgatccacccgccttggcctcccaaagtgctgggattataggcgtgagccactgcgtccagccggcagcacccctttctttcggagtggcgcattacttctctatggcgggtggtgggtaaccctgcatggaggccagcctgggccttcagcacctgggcgaacacctggggtgtcctgggcagacgcgtggggtgccctgggcctgctgtttgcaggagctccctgtggcagagcgggggccagaagagcctccaggcttcccaagtccagggctccccactccgccccaggcctctgagccaggccagaccctgaggcttctcaggggccacccccccagctcccagaggcccctcctgtcctccagcgaggcactgacccmccacttctcacagcatccgtatgtgtgttttggtggctgtgggttgtatctgtgacctattttccctcaaaatcaagttcagggaaaaggttttttcgttatttttgttttttttaattcttgggagggaaggtgataatattgttacttacctgagagtccccctcggagacccccagaagctggttttaagggaagaaagagtaagatccctttctgtgtctctgtctctggccccgtctctggccccatccccgtgtctctctggccctgtctctctgtctctgtgtctctgtccccgtcccgtctctcgctgtccctggctctgtccgtctttcttccccatttaaggagcgcctcctctccggtcccctctgaggagcgctggatggaggacagggcctcccggagaggactccacggtgggtggtgggagggaaagaccagggggaggcagaggctgccggtgagaggcgtctgccaagtagatgaggggccgggagaagaccccgtggctggggaagcaggagtggggagggcggggcctccgggccgaggggcgcggtcgctgtggtctgtggaggggcyggcgaggctcccgcctctgctcttgctggagctcttgagtgagccctgtgacgcctgctaggtgaggtggcagccagtgagcgcgccccaccgcccagcgccgcccagcctccgccctgactcctctgccgctccccaaacagggcgcggtggcgtgaccctggcgctggggggcgagcgcggccctcccggtcccgcaggcgcaagagagggcggagatgcggcgcctgaggcggggctgcgcwtccggggcggggccggcggaggctggagggggccgcccgggagcagaggcaggacttgcggcgcgtgcccctcacccyagcccggggctgtcctgcctcgtggggagtgtgaaggccatgcccggcgccgcggccctggtgcccctgttccactgggaccctggggggcgccgccaggccccttggcctcttcctcggggccctcgggacccaggggccggtggtggccgtgccggggactcgggcgtgaggggtggagatcgcggccccggtgcagcagctcagaacctggactctggatcgctgctccccagcgcccggggtgccgcttcccacagggttcagctcccatgcaggctgcgctcaccagtggaagtgggtccacccggtcccaggagagccagagccccgtggcagtcgctgtggggtgtgctccgcacaggccagagagccggcccaaaaacctgaggtttgcaaagcctctttctttctttttttttttttgagaaaacgtctctgtcgcccaggctggagagcagtgacacgacctcggctcactgcaacctccgcctcccgggttcaagcaattcttgtacctcagcctcccgagtaactgggattacaggcgtgtgccaccacgcccggctaatttttgtatttttaatagagacagcgtttcaccacgttggccacgctggtctcaaactcctgacctgaggtgatctgcccgtctcggcatcccaaagtgctgggattacaggttcagtgagccattgcgcccggcccaaagcctctttcttttcrgtgctgagctggataaagtctaccaaactgaaaggtctccaaggctatagctggctgtctgagaaattatggtgtttgtttagcccatcttaggacttgggctatcccaggtgactgagttttgctgtttcacacctcccaaggttcttctcattcttccttttctccattaatggtaacttgtcttctcaattgctcaggccagaaacctccgttaccatcttttcttacgtgtttcacatccaaaccatcagcacatccgggtggctctgccttcaagatagatccagaagctaggtcctttccactgcctccaccacggccacctggcccaggccaccctcctctgccacaagggtttttgccattgccctccctggcttcctgtggttgcagtcagagacctcgtccctcccactcagccttctcgagggcttctgtctgctcagagtcaaggtcacggcccttccgaggggtgaggatctccttcccctggccacactggcctcctgttcctctccagcaagaccaggcctacgtacccaggacctccgtctctggcacttccacctggtctgctcttctccagggtagctgcagggaccctgatcccctgcctggtctgtgcacacttctcagggagggtgtccttgtcccttttgggtaggttttcacagtgccccaacagccctgtctccctttctgcctcatctcctaatgtacattcagttctgcatcattcactcatttcttgtgtattgtctgccctcgctaggatgtatgctccgtagggatgtatgactgttccgtcagcttctccctggaagagtgtccagcacgttgaatgatgaaagaattgatcagctatgatagatcacaagcctcgttccagaggccacacattggattcagaagcttctattccttatctccgtgaaagattgcaacgaaaatcttgatttaaaaattctcttattgtctaattaggaaagttttattgaagtccaaatattcccatcctcaccttcccacttttcaccgggagtctgaggaggaaatactgatataaaaaatttttaaatcatcatttaagaaaaacaaaaaaggaaatactgaaagaccacaggccagtctggaaaaggagcggactctcccactctcctgcttcaggtcacctatgtttgccctgtgcagccagcaggcagagtgctcattacctgctctccaccctcggttctcactctgggccccagggctcggccactgggccaggccacatgtgcggccctccttggttccaagctgttcttggacgtggtctcctccacccccagagcctttgctttcctttccccmgatcttcttttcccagacttcctggaatttataatccaaaggttgtgtaatttcagaagctgcgatggttccaagaactcctgtccccgtcagtccgtcttctgcttgcgcgggcctggaggagacactgggggtcagtcctgatcccgtccccatcagtctgtctkctgcttttgcgggcctggaggagacgccgggggtcagtcctgatcctgtccccgtcagcygtcttctgcttgygcgggcctggaggagacactgggggtcagtccaatcctgtccccatcagtccgtcttctgcttgcgcgggcctggaggagacactgggcatcagtccgatcctgtccccgtcagtccgtcttctgcttgcgcgggcctggaggagacactgggggtcagtcctgatcccgtccccgtcagtccgtcttctgcttgcgtgggcctggaggagacgccgggggtcagtcctgatgtgcaggccggtctctgtgcttgggcatctttgggctccgtagatgaggcttgtgcggccacagagctgcttctgtccctgctgctgctcctgggtgtcagtgtccgttctgtcaattgaagcactgagacttgagggttaagcaggcctgggaagcaggtctttgggattgcctctggggatcagtccttctcttccagcgcccctgatgggtagcatgcagtggggctttcctgtggtccccgcacaggtctcccttagaaaatgagtaagagcagggcccgtgcatccagccagggtgagggtcatgtgagtgaatcctgaaaagccgctcgggagcacccagtccttgctgagcgaggcaggaagcaggggtccctttgagttcgcccagcagaacagccaacccagcggcccctccctgctgtcctgtcactgcacccccacctctgagttccaggcctgtggtgtcatccttcacacttagtgggatgagagactgaaccccacaggagaccttctaaaggggtctcctggccactacacaggctgctgtgaagccccagcccctcctcagggaagcggggtcttacttcccttttaaaccccgcctgcccctgggccctcacactctggctgctccgagaccctgcatcccctttcattttctccctgatgctctttgtctccttcacacactcttcacrccagggcaccgtgcctcccgtgtgagctgctttcagccttgctgtaggacatgkaggacccctgagctatttggggtcacaaggaagctgttagtatgtggttctcatattcttaactgtacaagaaagcaaaagccccttgaggtccctcagtatcccttcccaccacctgcaccccacaggtggagaaattgcctgcttttagggagatagcagtgtaggcctctttgcttgcgccctgcctggcccctgttggatctcttttctctgcaggaactgcagaggcttctgaagctggatctttcactatgacatttacagttgcttgaccattttctcccgctcttgacaggtcccccaggattagctgtggccaccagaagcaagcgtcgatatggaacgtgcattctgcttaaagctcagcaaggcatggttggagggaggccactgatagtctcattcttttgtcctcagagccccccaagatgaacccagtggtggagccactgtcctggatgctgggcacctggctgtcggacccacctggagccgggacctaccccacactgcagcccttccagwacctggaggaggttcacatctcccacgtgggccagcccatgctgaacttctcgtaagttgtctccctccaccccaccctgcttgactcatgggccgcctaggtctctgaaaataattccagactgatcaaagacaaaggccaagcaggaaggtgtaaaaggaacttgtccatctatttcagaaaggtgtcctcttgcctgaatgtgcaactgagacacagagtggtaaaaatgatactttctggttctgttatatttttggagatattaagctgaccaccaaattacaggcttgttaatccaaacataaaaacaaatgcatgtacttaatttatgtatcaaaattaatcaccctggccagtgcggtagctcatacctgtaatcccagcactttagaggctgagtcaggaggattgcttgagcttaggaattgaagaccagcctgggcaacatagtgagaccttgtctctactgaaaagtatttagccaggtgtggtgacacatgcctgtagtcccagctactcgagaaactgaggtgggaggattgcttgaacccagggagggccaaggctacagtgagctgtgatcataacactgtactccagcctgggtgacagagtgagaacctgtctcaaaaaaaaaaagaaaaaaattagtcacccaatattactgaaaataatagtgcatgtttgtattttacacgtacccctgagctatttggggtcacaaggaagctgttagtatgtggttctcatattcttaccgtacaagaaagcaaaagccccttgaggtccctcagtatcccttcccaccacctgcwccccacaggtggagaaattgcctgcttttagggagayagcagtgtaggcctctgaagtagaggagagccaccagggatggggagtggttgaagtatctttattttttaattatagaagtaatacacagtttttttaaagtttaaacaaaatataaaaagcaaaccctcccttagtctccattacacaactatatgttaagaatcttattaaaccaacttggtactatttgtataatgcctagcagtttcagaacggggctgggcacctggctctcagacccccagctctgagaccctccatccccttttagaagatctcattgtttttaaaaatatctcctacctttttatattattattgattgaatgcatgaggtcaaagtaatacatctgcacataaaccaaaaggtgagaattctgggtaatacaaaataacccagaacccaagcagtcttttttaaactatagattataacccacgaaaaggtcagaaagtcaattttgtgactagcattcgaagaaaaatgaaccagagtggaaaatatatttcagtaaatgtgatggtatgtgtgtttgtgtgtgtgtcctagaatatggtataaatgtatttctttgtcggggttatgttagtgagcatgtaccattctagaaggtgtagcaccatcactagcccaacagaaatttatcttggcccagcgcggtggctcgtgcctgtaatcccagcactttgggaggccaaggcgggtggatcacttgagtccaggagtccaagaccagcctgggcaacacagtgagaccctaaaaaaatttgttttaataaataaataagtttatcttggccaggtgcggtggctgacgcctgtaatcccagcactttgggaggtcaaggcaggtggatcactagaagtcaagagttcgagaccagcctggccaatgtggtgaaattgtgtctctactaaaaaaaaatacaaaaatacaaaaattagccgggtgtgtggctgggcacagtggctcacacctgtaatcccagcactttgagaggctgaggtgggcagatcacctgaggttgggagttcaagatcagcctgaccaacatggagaaacctggtctctactaaaattacaaaattagccgggcatggtggcgcatgcctgtaatcccagctactcggtaaggctgaggcaggagaatcgcttgaactcaggaggcggaggttgcagtgagccaagatagcgccattgcactccagcctgggcaacaagagagaaactctgtctcaaaaaataaataaataaataaataaataaattagccgggtgtggtgggcgcctgtaatcccagctactcaggaggctgagacaggagaatcatttcaacccaggaagcggaggtttcactgagctgagaccgcgacgagcctgggtgacagagcaaaaaaataaataaataaagtttatctctaagaatcatagagatggattccctatagaaactcataaggttggtgaaatgataaatgaggcttttttttttttggtttggtttttttgtttttatttttgtagaaacagggtctgtgttgcccagccctgtctcaaattcctaggctcaagagatctacccgactgggcccctgaagtgctgggattacggccttgagtcaccatgccagcgagttagtttttaagccgtggttttgtgccctcagttcaagatgcaggtgcctgtcttttactgttgagaatttgcactaatgatgaagggtgataagaaaccataccataactcagcacctgttctgttttttaccgtaggaattgattagattcttacacaagagcatagctcaaaagagaaagattgtgttagggtgaggtttactgcaagggagtgctgagggctgacactgtgtgaggcctgggctaacgggcccagggcaaggatatgccctgaggtgattaagaacagtgctgtcttcaggagctgagggtcagcaggcaagacagacacagccaaaatgagcaaggtggtggagggggcgggcaggtgtgtgggcgtggctggaacagcccgtcttcaggagtggagggtcagcaggtaagacagacacagccaaaatgagcaaggtggtggtaggggcagacaggtgtgcgggtgtggctggagcagccacctggagggcaccctggacagttctggcatccacgcagcccacgccatcttggaggccagtgcctgggcttctcaactccaacttcccgtccaggttcaactccttccacccggacacgcgcaagccgatgcacagagagtgtggcttcattcgcctcaagcccgacaccaacaaggtggcctttgtcagcgcccagaacacaggtgaggcccagcttgcggggcgggagggctggccatgggaggctgctgcctgcattcgaagcaggggtgcagggatgcccatgtgcraccctgctgaggcatgtgctggtggggaccgtggggatggccctgagtgttgagagtggtcctgggagcctgcggggccgactgtgtagctgtaggggcctccggcacacaggttgtgtgcgtgcagccccctgaccatgagggcccgtttacccagtgccacgtctgcagaaatggccatcagctgtgtgcattcattaggaattgctggaaaacaggttgggcacagtggctcacgcctgtaatcccagcactttgggaggcctaggtgggcagatcacttgaggtcaggagttcaagaccagcctggccaacatactgaaatcccgtctctactaaaaatacaaaaattagctgggtgtggtggtgcatgcctgtaatcccaagccacttgggaggctgaggcaggagaatcacttgaacctgggaggcagaggttgcggtgagccaagaatgcgccactgcactccagcctgggcaacagagcgagattctgtctcaaaaaaaaaagaaaaaaaaaaaaaccagcctgcgtgactctagatcagtgtttcttcctggacgtccattcccacctgcgacttctgccactgtatgtgctaggggtggttctgccaggctgattggtgggtggaggtgggagggctggggcccagtctggagagggtggccttccatagagcacctgcctgttctgtgaggagagttgtggctttccctccgtatccacagggtgaagtggggaggaggagaaatatcgttgcttccacagctgcagagttggggcctcctgtggagtcccggcttgcaggcaaggagagtcaaggctgcctctctgcaagccgagcagctgctgggtgagctgactgcccttcccttgcaggcgtggtggaagtggaggagggcgaggtgaacgggcaggagctgtgcatcgcatcccactccatcgccaggatctccttcgccaaggagccccacgtagagcaggtgagcccagccctgctcccagcacgctcctgtcttctgtttgcagcggtctgtggagtcagcctcttcctcttccgtgaggtagtgcgtgtcttgccactgtgtctcacaggcctgtcttcactgtctccttcttttcccttctcggaccatccagggtggatgttccctaaattcattgccccctcctcggctggtcagtggtgtggtttttttgaggtttgttgtttgtcacaaacatccttttgcatttgggttgtccacgtttacagatatatccatatctattgataaatttttcccagttaaattgctggatcaaaggacaggtacattttaaatttgatacacactgttagattgtatttcttcatgattatcctcccactatctcttgcatgagggcagctggttccctactccttaacaacatggtgtattttcagaatttcggtcctttcaaatctgagaaataaaagatgaaatctcactcatgttttgaatctaacttagaagcaggagggctcattccccatgctcactggctgtttacgcttcttattctgtgcacttgatatttaaagtctttgcctgtttttctgtggattgttcttttttgaggcggagtttcgctctgttgcccaggctggaatgcaaaggtgggatctcggctyatcgcaaccaccgcctctcaggttcaagcgattctcctgcctcggcctcctgggtagctgggattacaggcatgcgccaccacgcctggctaattttgtattattagtagagacagggtttctccrtgttggtcaggctggtcttgaattcctgacttcaggtgatccacccgcctcagcctcccaaagtgctgggattacaggtatgaacaaccgtgcccggccagattgtccttttttttttttaaagatttgtaggagctttctgtatgccatgggttaatctgttgtctgctttatttgtgacacatacttccctagtctgtggcctggtccatgatgggctgtgccccacaggtgctcagctttcctgttgttgcctctgggctgtttcctttacaatgtctggatttgggttcttgctaaggaagttgttgtccactccaaaatgataaaaatattctctcattttctttctttttttttttttttttgagacggagtctcactctgtcacccaggctggagtgcagtggagcaatctcggctcactgcatgttctgcctcctgggttcacgccattctcctgcctcagcctcccgagtagctgggactacaggtgcccgccaccacacccagatcatttttttgtgtttttagtagagacggggtttcgctgtgttagccaggatggtctcgatctcctgaccttgtgatccacctgcctcggcctcccaaagtgctaggattacaggcgtgagccaccgcgcccagcctgttctttcatttcttgtattcttacagctttcctttttacattaccacctagacctttaatctctctcacatttgttttttgagtgacgcagcgtataattctaactcttccagatgagtgacccagtrgtcccaacaccattcatcgaattccatcctgactccacagatttggaatgtcatacatacattaaaccacatccacataaatataggggtctgtttctttttttcttttttcctttttttgagaaggagtcttgctctgttgcccaggctggagtgcagtggcacaatctcagctcactgtagcctccacctctcgggttcaggtgattctcctgcctcagcctcccgagtagctgggattacaggcatgtgccaccatgcccagctaatttttgtatttttagtagccatgttgaccaggctggtcacaaactcctgacctcaagtgatccgcctgcctcagcctcccaagtgctgggattacaggcatgagccactgtgcccagcctcgtttgtctttcttcgtctgcttgtccacttccttaccagtaacacatttttagctctcacagctgtatattacatgttaatgtctaagggaacgkttcccacattttttctccaaattttcttactcattcttaagcatttcctcttctagatgaacttttgaataaacatctcaaggcttataaaatgtacatcaagactgcattgaatacatkaatgaatttgggtagaattgacatattttcatgggtagcaatatgcagcgtgacagtgtattacggtgactttaggtcatgttttgtgtattttagtatatagaaaagctttatttctttatagttttaattatacaggtcttgtacatttcatgttagggtaaactcaagtgttttatcatttttgttrcttgtaaatagattttttcccatttaatcttcagattgattattgataattgtgtggacacttctgatttctctgtgttgaactgggccactggtgtaactttcagacagccaggatcttaggcacagcatggatagaacaacaggcgtgaatgtttgttgcatgcttgtccctgactctagtggaaatagttctgtgtgtcaccacctgtaagatgctcactgtagattacttactggtagataagaaggtagcttttttttttttttgagacagagtctcaatctgttgcccaggctggaatgcagtggcacgatctcagctcactgcaacctccgcctcctgagttcaagcgattctcatgcctcagcctcccaagtagctggggttacaggcatgcaccaccacacccagctaatttttgtatttttagtacagatggggtttcaccatgttggccaggctggtcttgaattcctgatctcaagtgacccacccggctcagcttcctaaagtgttgggattgggcatgagccactgcgcccagccggatagccttttttttagttgtaaaatttttctacttttttttttttccagtgcaggtgcgtatcttggtaaaggcagtctttttcaggttaagaagattcagtttctagtatgccaagaattgtattcagaaatgaattttgaatttcatcaaatgcttttataacctgttggggatgaatctgtttttcccccttgtcttcctcttgaagctgttaatgcagtcctcactgcaggaggtgagtggccagcaggtgagtgggcatgacctcctgagctccacctcctgtccatcaggtggcagcattagattctcataggagcacgaaccctgctgtgaattgtgcatatgagggatctaggttttgcttctaatgagaatctaatgcctaatgatctaagatggaacagtttcatcccaaaaccacccccacccccacagctgtggaaaaattgtcttccatgaaaccagttcctggggccaaaaagtttggggactgctgtaataaattatattaatagctcatcagtgttggatcatggttgtttttgggggataaccctgagttgtcatgatatgttgtttttagacatcattgtccattttggtattggagttattcacaggctagctgggagcttcttagcttttgcaaatgttctctggcaaagggtggccccgtgggagttggtcggcctctctgggaaggtatctggtaaccagacctaagctgtgcttttactttgttccgtgactgcttgtctctccacgttcttacttggctccatctgcaaattcatgttctcctgcaaaagtgtccgtttcatgagattttcagaatttttggaagaagtaatagatactgttttctcttgatgtgctgttctatgtcacttctcttttactgatgttttgtgtgtgttttctctttttcttgatcatacttgtcagaggttatctattttaccagggttttttgtttttttttttgtttgcatgtttatttttgctaaataactagatttgggttttattaatttaacaaaaagtggctctttttctgcaaatagagggaggagacagagacgatggagttgcgaagcctgggcatggcgcttaggggaaggctctgtgccatgcagcccctgcaccctgggggctttggggacctctaccgagcgacttaatggacagaagctggaagcacaacctgaggggctgggcctccccattgggttgacatcagcaggaytgaggaagccaggaagcacacacagaaggcagggaccttgaggctagaaggagagcaggaggcaagaagagctgggtcttggagggccagtcctactaggcttgtgcgggggtgaaaggagctgtccctgttattacagtgttgggggaatttcctgggactttgtttgtagccaaatacaaagtcagtgtttatcatctttccaatatgtattgggggaaatgtgtcttccttgttaggttcagagttctgtagctttatgtgctgcataaagaagttttccagctgggcgcagtggctcacacctctaatcccagcactttgggaggctgaggcaggtggattacctgaggtcaggagttcgagatcagtctggccaacatggtgaaaccctgtctttactaaaaatacaaaaattagccaggcgtgatggcgggcgcttgtaatcccagctacttgggagcctgaagcaggagaatcgcttgaaactggtaggcagcggaggttgcagtgagccgagatcgcgccactgcactccagcctgggcgacaagagcgaaattccatcttggggaaaaaagaagtttccttcagtgacggactgacagaccccacttatgatggtcaggccataagattgtaatggagctgaaaaatttctcacttcatgagtgaaagaagccatctaatgtagcacaattactttttaaaaataaaaatatgtttataaatttaatgcagcctaactgtactgtatttataaagtctatggtagtgtacagtcatgtcctagaccttcacattcacccatcactcactcactgactcacccagagcaactgccagtcccgccagctccactcatggtgcctgccccagacaggtggactttttgttgttgttgttgtttttgagacggagtctcgctttgtggcccaggctggagtgcagtggtgcartctcggctcactgcaagctctgtctcctgggttcactccattctcctgcctcagcctcctgagtagctgggactacaggtgcgcgccaccacgccaggctaatttmttatatttttagtagagttggggtttcaccgtgttagccaggatggtctccatctcctgacctcgtgatctgcgcacctctgcctcccgaagtgctgggattacaggcgtgagccactgcgcctgggcgacaggtggacctttttatcttttttgttttttccgcaaatgttttgaaggcaacaatttagatttttttttctttctttcttttttttttttttttttgagacagagtcttgctgtgtcacccaggctggagtgcagtggcacaatctcagctcactgcaacctccgcctctggggttcaagcaattctcctgcctcagactcctgagtagctgggattataggcccgcgccaccacgccaggctaatttttgtatttttagtggagacggggtttcmccatgttggtcaggctggtctcaaactcctgacttcatgatccgcccacctcagcctctcaaagtgctgggattacaggcatgagccatcacgcctggcctaaaaatcttttatactgaatttttactgcagctttcctatgtttagatgcacaaagactttgcattgtattacagttgcctatagtatataggacagtctgtctaccgtacgtatacatatacacgtaactatatgctgtgcaggtttttctagctaaggagtcatgggctgtcccagagagccgaagtgtggaggaggccattccatctaggtttgtgtaggtgcacgctgtgatgtttgcacaatgatgacatcactgaatggcacatttctcagaatgtatctgtccttaagcaacccgtggctatttgtctttaaatgagacttcctaatcgtgattgaaattctctttggcccttttttcttcttcatctgtcagtttgtgagttctgctacgtagtgttcccactcaactgacccttatttcttgttcgttagaggtaaacggtctcaactctttgaactgattcatttagtttttagctccatatttagccatgaggtgtgttgattgcttcctcttaacattgctgactacgccttactgaccgagcgtctgctcaccgtggatgaagaagattctgctcccgtacccaagaccccaactcggttcccatgcatgtcctactcccgccttcccggagagtgtgtgtcctgattttactgggttgccactgttacagccgagtccccacgctcacagccagatcacgggctccacgatggctgttccttttccgtgtaccttttttgagttaaaaatgttatttttttttkgtttgcttaatgtttacatgcttatccctgagtcagcaccatgcgttctgccggtatctaaaactcagcttgggtactcagatgtgatacctgaattccacctgcggaactctcagagctgcttgatctgctctgttaagaccaaggagtagagctgccatccctgagactccctccccactaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggctaatttttgtatttttagtagagtacagggtttcaccatgttggccaggctggtctccaactcctgtacctcagtgatctgcccacctcagcctccccaaagtgttgggattacaggcatgagccaccgcgcccggcctttttttttttttttggagacagagtctcactcttgtcgcccaggctggcatgcagtggcatgatctcggctcactgcaacctctgcctcccaggttcaagtggttctccttcctcagcctcctaagtagctgggattacaggcttatgccaccatgcctacctaaattttatatttttagtagagatggggtttcaccatgttggccaggctgttctcaaactcctgatgtcaggtgatccaccctcctcagcctcccagaatgctgggattacaggcgtgagccactatgccccgccccaagttgcttttaattttatgtttgtttgtttgtttgttttggttctggattggatcttataggccacctttagatgtctggggtcccttggaccacccccagccaggttcactgggaggcctcataggacgtggcaggagctgacttattacagcggaaggacatggagcacggtcagcacagggcagggcacggggcagagtctggaggaaacaggtgtgagcttccagcatcctttccacgtgcagcccacgggacgcgctccattgcccagcatcgcattgtagcgacaggagtgaaatgtcccaactagggaagcccttcagaacctcagtgcccagggtcgttccggggctggtcttacagcagcctctgcctggttcttgctcccagtgtctgggcacagctgaggcccagattctcatgtcaccctctgctggtagagggaggcacagttgcctcggtacggggagctggtggtggaagctggggagtgactgctgctgccttgtttgtgtccatgtttgtttgccatatacctgtcactcagcatgtctcatgtatttcttcttcttttttttttttgagacagagtttcgctcttgttgcccaggctggagtgcagtggcgccatctcagctcatcgcaacctctgcctcctgggttcaagcgattctcctgcctcagcctcccgagtagctgggattacaggcacgtgccatcatgctgggctaatttaatatttttattaaagatggggtttctccatggtggtcaggctggtcttgaactcctgaccttaggtgatccgcccagctcagcctcccaatgtgccaggattacagatgtgagccactgcacccggctgtctcatgtatttttaacagctctttaaagatataatgcagggctgagtgcggtggctcacgcctgtaatcccagctctgtaggaggccaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcgagactctgttatcagaaaagaaaaaaaaagatcttcacatactattcagattgctcacagtgtgcaattctgtggtttttagtatgttcacagcyctgtgtacccatcactacagttaatttcagaacatttatcttctgtggcacaatcataactcactgcagcctcaacccccctggactcaggtgatcctcccacctcagcctcctcagtagctgggactgcraatgcgcaccaccacacctggctcatttttttgtttgtttttgatttggggtttttctttaagagagggtctcattccatcacctaggctggaatacagtagcaagatcttggctcgctgcaacttctggctcccaggcttgagcgatcctcccacctcgccctcccaagtagctggggccacaggtatgcaccagcatgcccggtttttgttgttgttgttgttgttttgttttgttttgttttttgtatttttagtagagatggggtcttgccacattgcccaggcaggtcttgaactcctgaactcaagcagtatacccacctgggcctcccaagatgctgggattacaggcatgagccacctaatgagcacggctactttatttgtagtttttgtagagacaagcttttgccatgttgcccaggctggtctcgaactcctgggcttaagcaatcctcctgccttggcctcccaaagtgctggaattacaggcataagccacaacccctggccagaacattttttataccccaaaaagacacctggtaccctttagctgtcagccccaacttccatctcccccaacccctggctaccactaatcttccttctctgtagattgcctgtcctgagcatttcatagaattggggccatagactgtcacttagtgtaaggtttccagagtgtatccaacttggagcatgcctcaggcctcactccttttcatgactgaattattccattggtgatgtgctgtattttgtttatccattcctcattgatgggcaagttgttcgttactgaatcttggctgttaagaagaatactgtgcctcgcgtggtggctcacrcgtgtaatcccaacactttgtggggctgaggcaggagatcacttgagcccaggagttcaagaccagcctggacaacatagcaaaacctggtttcacaaaaaatacaaaaagtagccgggcttggggaggcatgcctgtagttccagctacttgagagggtgaggtgggagaatcgcttgagcctgggagccggaggttgcagtgagcagtgattgtgccactgcactccagcctgggtgacagagtgagaccctgtctcaaaataaatacatgaaataatactgaattgcctctgaaacacattttcaagcaaacctgctgttttcagccttcatccacggccactggtagagacactcaggccacgccacggagcttttgtggggtgttaaggcaggctgttcgcctgtccccagtgctgcattcagcctcggccttcctgggtcggctgtgtcgggtccccgtgtgcgtctcatttccagcccctcacgttctgtggctgtgtgccgcctcccatctttctcctgcggattcatgctgtggacagcattccttcactgccattccagtcgggggctgttgcaggagacacagtgctgtcctcacccgggaggcctcacctcagagctctgtgccggcttgctgggtgagcaagattttcatctacattttaccgttttttttaattttttactttttattttattattacttttttttagacagagccttgcactgtcgcccaggctggagtgcagcagtgcgatctcggctcactgcagcctgcacctcgtgggctcaagcgattctcccacatcttcctcccaagtagctgagactacaggcgtttaccaccactccccgctaattttttgtatttttaatagagatgggggactcactttgttgctcaggctggtctcaaactcatggcctcaagtgatcaacccgcctcagcttcccaaagtgctgtggttataggtgtgagccaccgtgcctggccagcttttccttttaagatgcatggtatttgggattattgtttctctgtagtgtgaggtagcagtcccattttccctttttccccgtacagacgtcccgtggcccttgttaggcactgtggccccgctgactgctgtttggggcatttccctccttggctgtcaggattgatgctgccggccatagcgtcagacacggtgtctgcatgtggatgcagaagcacccggtttttccccctcgctctggaggagcgggctggaacctctcgaagagaccgaggcttatgttggggaagtgaggctttcctttagctgctccgtggcatctgggggatcaggctgggatgggacgtgtgagtgtctttactgtttgtgtgggtgttggtgggcatggcscagactgcaggccccacagagggtagcaatgcctcaatgagctgtgtactgagcctggtggagcctgtgagctgccgagggtccctggccagcttgccccagggacagcttgtcactcatgtccggtgactgagcagtggtggcacaccccaggggagaactgagtgtgttggaagaggctcgtgtgactctttttgggagggcctgaggggtccccaggctcccgctgacctgcacattccctgtgctgtgtgtgtctgtgctttgtaacttcagggccccatgcagtctgtgtagcacgtgccttgcagcagccctgagacgaggcaggtccaggccaggccccattttacagtgaggctcagagaggcccccagcctggcagagcctccccgcttcctgccttatgtgggtggctctggacctagctttgcagcctgggctgccaccggtgacctgygagcttgagcatcttttcacgtcgttgctgggtcatcctccagcgaggtgcctgttcaggtctggtgaccatttccactgtgccttttctggctgacatgtcagagttctttatatgatttgaataaagctctgttagctaaatgtgttgcaaatagctttttcggtctgtgattatcttttgagttttacaaattgtttttgaagaacagaggttctggattttatgtggttcagtttgccaatctcttcctttatggattctgtttttaatgtcttagttaagcagtctttcctcactaacaggtcaaaatatgtattctgaatttttctggaagcttcacagttcaacctaaaatctttcctttaggtcattaatccacctggggytgagttgtgtgtatagtgtgaagtgctgtcccctctccttgttctcagatgagggccagctaccctgcaccctgcatgaagagcccggcccccctgttcacccatgcaactgccccctgagcccctcagtatccttcatcaggggtctgcttctcaccctctctctggttccaggtggtctgtttgtcagtccctgtgccaataccacactgtcttcattatcatggcttctactttttaaaaatcacctctattgaggtatactttatatggaataaatgcatacacttcaagtgtgcagtttgatacatttggacaagcatatataatcttgtaacgctgcgccagtcaagactgagaacagtcccagcaccctagaaagtccccgtgctccacaggcaacccccgctgccctctcaagcccccggcctggtttctgccactgtagaccgagcagctctgagtgtcctagtgcccatgatcatcagccgagcagttctgagtgtcctagtgcccatcatcatcagccgagcagctctgagtgtcctagtgcccatcatcgtcagcctggcagttctgtctgtcctagtgcccatcatcatcagccgagcagctctgagtgtcctagtgcccatcatcgtcagccgggcagttctgtgtgtcctagtgcccatcatcgtcagccgagcagctctgagtgtcctagtgcccatcatcgtcagccgagcagctctgtgtgtcctagtgcccatcatcgtcagccgagcagctctgtgtgtcctagtgcccatcatcgtcagccgagcagctctgagtgtcctagtgcccatcatcgtcagccgggcagttctgtgtgtcctagtgcccatcatcgtcagccgagcagttctgtgtgtcctagtgcccatcatcatcagccgggcagctctgagtgtcctactgcccatcatcatcagccgagcagctctgcgtgtcctagtgcccatcatcatcagccgagcagctctgagtgtcctagtgcccatcatcatcagccgagcagctctgtgtgtcctagtgcccatcatcatcagccgagcagctctgagtgtcctagtgcccatcatcatcagccgagcagctctgagtgtcctagtgcccatcatcgtcagccgggcagttctgtgtgtcctagtgcccatcatcgtcagccgagcagctctgagtgtcctagtgcccatcatcgtcagccgggcagttctgtgtgtcctagtgcccatcatcgtcagccgggcagttctgcgtgtcctagtgcccattatcgtcagccgagcagctctgcgtgtcctagtgcccctcatcatcagccgggcagttctgagtgtcctagtgcccctcatcatcagccgagcagttctgtgtgtcctagtgcccatcatcatcagccgagcagctctgagtgtcctagtgcccatcatcatcagccgggcagctctgagtgtcctagtgcccatcatcatcagccgggcagctctgagtgtcctagtgcccatcatcatcagccgagcagctctgtgtgtcctagtgcccatgatcatcagccgagcagctctgagtgtcctagtgcccatcatcgtcagccgagcagctctgagtgtcctagtgcccatcatcgtcagccgggcagttctgtgtgtcctagtgcccattatcgtcagccgagcagctctgtgtgtcctagtgcccattatcgtcagccgagcagctctgagtgtcctagtgcctctcatcatcagccgggcagttctgagtgtcctagtgcccctcatcatcagccgggcagttctgtgtgtcctagtgcccattatcatcagccgagcagctctgagtgtcctagtgcccatcatcatcagccgggcagctctgagtgtcctagtgcccatcatcatcagccgagcagttctgtgtgtcctagtgcccatcatcatcagccgagcagctctgtgtgtcctagtgcccatcatcatcagctgagcagctctgagtgtcctagtgcccattatcatcagccgagcagctctgcgtgtcctagtgcccattatcatcacccgggcagctctgagtgtcctagtgcccctcatcatcagccgggcacttctgagtgtcctagtgcccctcatcatcagccgggcagttctgtgtgtcctagtgcccatgatcatcagccgagcagctctgagtgtcctagtgcccattatcatcagccgagcagctctgcgtgtcctagtgcccatcatcatcagccaagcagctctgagtgtcctagtgcccatcatcgtcagccgagcagctctgtgtgtcctagtgcccatcatcgtcagccgggcagttctgtgtgtcctagtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgttgtacttatttgccacttgtatttcttgttttgtgaaatgaacattcagattttttgcccatttgtttaagtgtttgtgttattcctgagttgtaagagcctgttgtttgttctgggtataagtcctttatcaggtgtacttgccaacacgatattcctatcctgtgccttgcctttctgtttcctagacagtaccatttgaagaaccaaatgttgttttttttggtgggggtggggggtttcttttctttttyttttttttttttgagacattgtttgctctcgttgcccaggctggaatgcaatggcctgatctcagctcactgcaacctctacctcccagattcaagcgattatcctctctcagcctcccaagtagctcggattacaggctcccaccaccatggccggctaattttttgtatttttagtaaagacggggtttcaccatgttggccaggcckgtctcgacctgacgtcaggtgatccaccctcgttggtctcccaaagcgctgagatgacaggcgtgagccaccatgcgcagtctagaaccaaatgttttaattctgttaccattttttttctctagtcagtgctttttgtgtcctgtcttaaaatttttcacctagcccaggcagcaaagattttcacctgcattttcttcaagaagttttatagttttaagatatatgctatttggaattgctatttctagatggtatgaggtagtagtcacgttttttccatttttcctcatacagatacctcgtttccagcaccatttgttgaaaagagaacccttaatttattaaagtatgcagtgcttttgtcgaaaatcaactcactttgtgtgtgtggttcttccccaggactctctcttctgtcccactcttctctgtttcggtctttatactgttaccatgctgtcttgatcattgtagctttatattgaatcaggtgatagaagttacccaacttttcttctttttcttttttccaaaattgttttggctatcctaggaccctttgcatttccttatgaatttcagaatcagcttgtcagtttctagaaacattttcattggaactacttgaatttctaaattaatttgggaagaagtgccatcttaggcaaactgagtcctccaatccagtgccatggtaaggtgctccatttatttagatcagtctcatcctatattttcttgtagttttcaacgtattggttttgcacacattttgttaaatttattcctacatattttgtggtttgggatgctattataaatgattttttaattttccacttatttgttgcaagtatatagaagtacaattagctgttgtatattgatctcgtatcatgtgactttgttaaattcattcatttctgtagtttgtttctttatttttcttcttttccttccctccctccctccctcccttccttccttccttcttttctctccttttttcttttttctttcaataaaaacaaggtattctgtgttgcccaggctggagtagagtggctattctctagtgatttttttctttttttttgagatggagtttctctcttgttgcccaggctggagtgcagtggcgcaatcttggctcactgcaacccccacctcgccagttcaagtgattctcctgtctcagcctcccgagtagctgggattaaaggcatgtgccaccacacccggctaattttgtagtgattttttttttctttgaacagggttatttagagatatgttacttattttccaaataattgagaattttttaaatagattctattgctcaggatttttcattcaattctataaggcccagacaacataccctctaatattttagtctgttaaaaaatgttggagacttattttacgccccagtatatggcctaacttcatgaatatttcatgtacacttaacgaatgtagcattcaatagttataaaagtcccctccrcaagctggaaaccctgggatgccagtgtcatggctcagtccaagtccaaaggcttcagaaccagggaagtcagtggtgtcactcttggtcctgggccaaaggtctcagagccctgaggagagaggaggtgctggtgacatctgggagtccaaaggtcggggggcctggaggtgtccaaggacgggggaggaagagtgtatcccagctccagcaaacagatggacatattcgccttatctttgtttttattttatctgggcccccagcctattagatggtgcccaccctcatggagggtagatcttcctcacctggtcagtcacctctggaaacatcttctcagacatactcaaaataatcctttaccgggtttctaggtgttccttaatcggtcacctttgacctttgacacctaaaattaaccatgacacccacacccacctctggctgctttcaagtttctattttcttgcctttgattatcagccaaagttttgctgtgatataattagaatttgtggcttgatatattttgttaggctcagaaaattggccatgatcttttcaaatattgcttgtgttctgttgtctttcctatcttcttctgggtctctggttacacatgtgttcagtcttttgcaattttcaatgtgtcccttatgctttcatccatattttccattattctctaagcttcaatgtggatatttcctactgatcattttccattttactaatcctttcttcatctgtgtctaatttgtctatttcattattggggccttaatttgagttattatgtttttcagttgtagaatttatattttaatctttttgataaattctgattacctgcagaaattctccatattgtcttctaataactccagtattggtatcccctgggtgagggtgggggaggtgtctatttcctgttttttcttttgatcttatctcctagtaacctaaggagtttttctttttttcttggattctagacaatatgtgtgaaaaattgtagagatgacttgaggcttcctttgatgttatcctcaccaaagagcagttctgtgcttctgcctgttggtcaaggatggacagctcgtgttcagtagaggctgagctggtttgaaaccggacttcccagcctgtttctggttaactcttactcctgggatgggacccttcagggaccccacccaaagctggggtgctttttttttttttttttttttcctcttcagatggagtctcgctctgttgctcaggctggagtgcagtggcgcgatcttggctcactgcaagctccgcctcctgggttcacgccattctcctgcctcagcctcctgagtagctgggactacaggcacccgccaccacacccggctaattttttttgtatttttagtagagacggggtttcaccctgttagccaggatggtctcgatctccttacctcgtgatccgcccgcctcggcctcccaaagtgctgggattacaggcgtgaaccaccgtgcccaacctcagggtgctttttttctttctttttctttttcttttttttttytttttttttttttttttgagaaggagtcttgctctgtcacccaggctgaagtgcagtggcatgatctcggctcactgcaacctccacctcttgggttcaagcaattctgctgcctcaacttcccgagtagctgggactacatgtgcataccaccatgcccggctgcgcctctcctcctagatggacactgaattccagtgtttgtccctccagctccatgagtctgagaaggccccacttagcttctcagcctcttagctaccacatccctctcagcctccaccccttgaaccccttgacttccgggcagcaaaagcatcggggccagttgctccaaattgggtctcacctccacacttccttctctttggggtgctggtcctcgctgacttggtggttctctgacacctttaaagaaacttcttaaaacctgggttgttatctgcaggagggttggtcagttacagagtagtcagccatggccataagcagaactccgtttcatccacttctggtgccccccaccccacatgaccccccacacatctggggcactagagagatagtgcccatcagagaattgtcttttgacagtggtcactctcacaatttgccggcaaacattctgggcatatagggctgactcattcgggacttagctgccataggcttggattcttgttggaaacagctgctataatttattctgatgaattactgttccaaagatggtatttctgagctttccaagaacacaytggacatcagttctagttacagtgaaagtgggaggcagtggagaagggaagcactggaagctcagcgcttgtctgatcaggtatatgatttgtagagaccaaaaaaaggtgacttctcccatccaagtactaaccaggcccgaccctccttagcttccgaggtcagacgagatcaggtgcgttcagggtggtatggccgtcgacaaaaaaggtgacttctaaataaacaatccctgtgttcccctggtggtcttctggaggcagctgaagggcacctggattgtgacatgcccaggggccctgggctgtgtgtctaccctcctctggcagggccactgcctggctcacagcccgtgatgagtgtgtggcatgcagtgggcgcacaggcattgattgaatcttttgaagataaaactaagctatctttgttccattctcctgctcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatattatcacttgcgtaggctgtacattttttttttatctgctgatgtttgttttccaaagcgttccctaagaaattaagaagggggctgggtgtggtggctcacgcctgtaatcccagtactatgggagaccaaggctggcggatcacctaaggtcaggagttcgagaccagcctgaccaacatggagaaaccccgtctctacttaaaatacaaaaaattagccaggtgtggtggcgcatgcctataatcctggctacttgggaggctaaggcaggagaatcgcttgaacccaggagttggaggttgcagtgagccaagatcgcaccactgcactccagcctgggagacaagagcaagactctgtctggaaaaaaaaaaaaaaaaaaattaagaagggatgaatctctttccttttctttcttcttacagttttgacaagatctaaaatatttgtaaatcttctatagagttggccgggcgcagtggctcacgcctataatcccagcactttgggaggccaaggcgaggaaatggcttgaagccaggagtttgggaccagcctgggcaacgtggcaaaaccccatccctacaaaaaaaaatagaaatattagccgagtatggtggtccatgcctgtggtcccacctactcagaaggctgaggtgggaggatccctggagcccgggtggtggaggttgcagtgaaccaagatcacaccactgcactccaacttgggtgacagagcaagaccctgtctccaaaaaaaaaagatggcagtcattttctcattacttttaaagagccgagtctatattttcctacagatggagcattcccaagaggctagctgtgatcttaacatcatcatgtaagttttagtttgtaactctaatacagctttcgtttttgtggggtttttttcactatgaaagtttccaaacatacactaaacccttgtacctgtcacccagcttcagcacctgccagcattttgcccaaagcacttccatcttttcctcccccacttctgcgggaatacacgtaagcaaattccagacatattgtcacttgcccctaaatcctttggtaggcatcacaaaacaacacaaagccattttctttctcttaactcgttgccatatcagaagtctcaccaggcacatggagacgaggctacacgggtgttgggaagcagagtcagaataggtagcacacaggctgcgcagggttaacatccagggtagcaaccgcaggtaccacctccagggcttggggacaaaaagtattaccagggtggggtttcagggacctcagagcttacaggatgtgcttggttctcgcaagaggggcaggagggcctaggactgtactccaggagccaagggggcaccaagggacctggtggctgggctcagagctgtctctgctcccaaagtgatgctgaaataacctgggaacaccagggaggtcccagccccaactcctgcatccagggctccagcacacccagctggaagggtgtgtggaagggcagcactcagggcagagcacagacaagccaagagacaagaagtcaataactgacggcacagtgctgttttcacaaaatgcataagaattctgtaatgttctctaacagtcctattcgtatttcccttactgcctaagaaatatcctcacacgattggattatcaaagctttattcacgtttgtgtttggctacaaagtcttttaggatccttttgatcctaaaagtccccctcttccctcccctgtgcccttgacttgttggtgaagctggtcacttgtcctcgaaggtgtccccagtctggacttagcatcctccttgtagtgtttaacttgttcctctgtcccctctatatcctgtcgtctggaagttggatctaaagttgtggctggaatcacacccggacggtgctcagttcctcgtgtcacagcctcatgtccaattgtgtcactttgttgaagcattaataagcttggatggcgacagcctgacccctttatcgtcagtttcccctcaactgttcccctgacagttttgccacctgtgggtgaccattgctagaaccagaaccttcactgggactgcagaattctcgtcttctgtctcatcagaaggacatttagtggctggaattctctcagaccttccctttatccattagggtaagtcaggttaccctgaagtgcgttcatactagaaaggcagcataagcacttaattatttccctttaatgatcaatttttggagtaagaatgtcctggcaccctccagtggtgccaaaggactgggagttcctcacaccactgcacttacccttcccgcttccctactcatgttacgagcttaatgctttcatgtatacagtctgtcctcagtatccacaggggtgcgttacaggacccacacgggtaccaaaatcagatgctcgagtctcttgtataaaatggcatgggatttgcatgcaacttatgcacattctcacatataccttaagtcatctctagattgcttataatacctgatacagtgtaaatgctctgtacgcagttgttatactgtatatttttggggttttttattgtgggcttttggggaatatttttatttttatttatttatttatttatttattttttgagatggagtctcgctctgttgcccaggctgaagtgcagtggtgcgatctcggctcactgcaagctctgcctcccgggttcatgccattctactgcctcagcctcccgagtagctgggactacaggcgcccgccaccacacctggctaattttttgtatttttagtagagacgggatttcaccatgttagccaggctggtctcgatctcctgacctcgtgatccacccacctcagcctcccaaagtgctaggattacaggtgtgagccaccatgcccggccaggaatattttttatacacagttgaatccacagaaatggagggccaactgtatttgatatcattttaatcaagtgctgcgtatatctttggcaaacaggagatgctcagattatctcgtaattggacagaggagcccctccatccagtgggctttgatgcctccttgctctggggccacagctgcctctgacttttcctgcccagaacctggaactacccatttctccagagccctggttctcgttagtggggagtgggaattggagggagtgggaattggaggccacagactgagcactgactgcttatgatggctgggctgctctacctcccagcctttccatggacaaaaccagaaaattgttctaaaatttattttctcagctaggcgcggtggctcatgcctgtaatcccagcactttgggaggccgaggtggatggatcacctgaggtaaggagttcgaacctggccaacatgacaaaaccccatctctactaaaaatacaaaaaattagtcaggcatggtggcgggcacctgtaatcccagctactcggggggctgaggcaggagaattgcttaaacctgcgaggcagaggttgcagtgagccgagatcacaccattgcactccagcctgggcgacagagcaagacactctctctcaaaaaaaaaaaaaaaaaaaaatttctggtttattttctctgaatcgtgaggttgtattagagatcaggacccttcacccttaactactttagcatgggatatacacatgtatttttgaaaaatatgaattcatactgttttccattcaaatgttaagattataagggtttttaaatattctttgattttacctcttaagctgaaaatcttggttcattacaacattaacattatttgctttattctacatataaatgcatataatcatttcaaaataagcctgggcaacatagtaagaccccacctctaccaaaaaaggtattgttaacaatgactactggtcaaagtttttttctgctagcttttttagacctttccctttgaagatacaaagttaaaatatgatgtaattggattaactactctgcgcttctgtcaccaacttgatacacaagtccatttgtttaaattctagaaattgttataatttgttttgtgaatacaaatcatttgactggctttcttgtcagaactgtaaaaccaggcacatttgctccacacaggcctctagcacagctaccgagtgctccggtaagctcgccgtgggttagctcgccgtggattagctcaccgtgggttagctcgccgtggattagctcgccgtgggttagctcgccgtgggttagctcgccgtgggtaagctcgccgtgggttagctcgccgtgggttagctcgccgtgggtaagctcgccgtgggtaagctcgccgtgggttagctcgccgtgggtaagctggccgtgggttagctcgccgtgggtaagctggccgtgggttagctggccgtgggttagctggccgtgggtaagctggccgtgggtaagctggccgtgggttagctggccgtgggttagctggccgtgggtaagctggccgtgggttagctggccgtgggttagctggccgtgggttagctcgccgtgggttagctggccgtgggttagctcgccgtgggttagctcgccgtgggttagctggcggtgggttagctcgccgtgggttagctcgccgtgggttagctcgccgtggattagctcaccgtgagttagccagcagatcccctcatgctgggccttgggttgtttccagtctttggccaatcaaatgtcagagttggacccagcacctccgttgggactgcagagtgcttgtcttctaagtctggttagaagggcatttccacatccttgtggattctggccatcgtatcttaaggatacatttctggaagtgggattgccagtcggcggggagaggctcatctggcttgtctgggtgttgtccctgtccccaaggggccaggcgttctgcatccccacagcattgtaggaagtccctgcccccctcagcagccgaatctggtgtcaaatttggatttgggtcaatcttgtaggtgagaaatggagtcttggggtggttttggtttgcatttctctctctcttttttttttttaatcattttcttgattttccaaactcatgagctcgtttgaataaggaatattaatcctaatatttctcattttaagttataatttttattgaggtaaaatatacataaaacaacatttttatcagagtcctatagatggttaaaaaaattcaccattttaaccatctcttaaagtctacaatttagcagcatttaatacattcataacgtacaaccatcacttctgtgtgcttccaaagccttcatcacgccagaaggagaccccgcgcccgttcaacaccatccccccaccctcagtccccgacagtcactgccctgcttcccactcaagtcaccgacactttgaaaatgtgctatgttataaaacttttttcccagtatacattttgtcttttatcactcctgggttttaagtcatatttaagaagattttgcccactccccggtgatgaaggaattcactttttcctagtacttttgacccatttggaatttgtcttagtgtatggtatgaagtgcagattcattttcgtctttctccaagtggttaacgtttaaccacttgtattaacaagtccatcctttcctcaccggtatcatatgctaccttatagactgaatgttctaggcactggggtctgtccccgggttttcatgtccctgggcctgcttgcctacatgggtcctggtgtcatgtggttccattacggaggccaggagatggttcaggggcagaggacctctccatttcttttgcagagttttcctggctatttttacactcttgtgcacttcctctctcacatgaactttataattagttttctagatctggggaaaagcatgcggcgtttttataaggattacattacatttataaatttactttt

SEQ ID NO: 12468 - DNA, 12965 bp, Homo sapiens
ttatctcagaatgcttgctcagcatatatctggggctagttaatcgatccaaagtaatacatctgaaagaatatacgcatgtaaaagtcccactccaatacacacctgggatagtggattttggtgaaggcagttgattccaccaacaaaaaccatattgggcatgatgggcctagggtaatccttcacaaagtcacttctaaacagccagacagatgcagagctcaataggtcctggacagtcacctctctctgaaggaattctgaggcaagggttgcatacggggaataaaccacgtcgcacagaaagttctgtgaaaaggcaatgagcatgttcttcacccgctgcaggaaggtcatgtgatctgaatgagaggagagaggcctgggcacgtaggagaatgggttggggcactgggtagcctcaaattccaggctgcatggcagtgcatgcaagaagaatacagtgggcagagacaggtactgggccacgatggggctgcaaggaaggaaagggtccgtcagcatgacatcaaagctgctttctgccagggaggccatgagctccttgttgtgcagtaagtgggaacagccagacaaaagcatagcagagtccttttttattttcttgtatgttttgatcacacgctgcaggaaagaatcattctcaaaaacattatgcccgagactaacaaaagactctttcacatcctccctttggaatggcacagggtacgtcttcaaggtgtaaaatgctccgtctctgatgtacaacgaggcgtcaggtgctaggacaactatttcatgtcccctctgctgcagctgctggatggccccaagcatgctcagccagtggctgccatccactgggatcaacagtatcttcccagcatgggacaccactgggcccagcacacacagcagcaggcccaggacaagtgggcgtccgccctgggactccacagccatggcgcctttgctcctgccagaggttcgccctctcctacttatatatatatatatggcaaaaaccaatcgatacaccaagttaatgtttgactgtgtcacgtgactataaaaagctgtcagtccacaaaggtagcagggagttcactttcagagataaagaaggtggagctttattaggtttcttaataggcaacaacagttgaactggctggaatttcatactcaaatcacattcttgagtgaacacagcaaagtacttccagaacctcaggatccattaaattagtatttccacagaccaacaagtgttaccagagaggaagaaggacgactatgtagtgaacaagttaggcttcttttccagaaattaaacagaaggctttttagaaagccttttagaaagaaaagaacacaactgtacccccgctttcgccatggaaacctgtaagagtgcccactccacagctcccccggtactgcctgctcacttgtatcatgtgtttcattccttcgtccaacaatatttattgagtccagcacagtgtggggtcttgaggctgcagcagagcccaccacacgagcacgcgccatgaggtgagccagactcacaatttaaacacatgagcaggaacttagaaatcgtgaagcatgctaagaaggaaatgaacaggtgggtgggtggggcgggtcgggggtggggggcgtgctggggtagagaatgaccagaaagggaaattcactggagcgcatgtgaacagaagtcttccccaaggacaggcctttattagtgtgaacctgaaagagccagtcctgtaagatagatcttgagtggctaactgggcctggatttaaaatagagccaactggccctttgcttactacaggtcacacggttactctgagtatcctgaaaacctgtacctttttatagttgagattttcagcgctcacctgaaccaaccaattaaagctcacccacctcagccactcagggctcagcttcatcaaccaatcagaatgcagctgcagtgaccaataagaactaagcaagtttccatccttcatttgcataaatggacctgattgggaacctgggaaggaactttttgccgtgaaacctgcctgccttgtgttctgtggaactcaccttcattgcgtaccagaggctgtaactccctggtttgcaaactgttcactagaacaaagtctctttcttccaaattccttttcagagaacttttgttcacaacaggaaaccaaatagataagcaaattcaattaagttaaattgtactcattccactggcccaagatccaggggaaaggcatttggggaaattctgatgactgatttgaagtcaaaagggaaagatgagcaaaaacaactcaaatttgtatttattgaccatggactatggggcaagtattgtgcagccagaattggaagtattacactctttttgggggggatatactgctgtactatacaattccaagataactgcacagatcccaacatttgaaccatacacatcactggccagccatacttggggatgtgcttagaggatcatagagaaacagctaactagagttttggtgtcctatgggacatattaacaggtaattagggtaccctctcattcttctccttagagtaggtactttgcatgcacatgcacactgaagctcctccccacacccaaacactcttcattttttaggaccaagattctgggcaagcagaatagacatagcaatgctttcactctttgttgtgtccttattagaaattctgaaattcacagtttaatttaaaccttaagggtgataattcttccaaagtcccaatgctgtgtgagttcatttgcagattatagacagtaaaggggctataaacacataagtcaccactgtaatgattttatgactttcctgcatcatgcagagcttccaagctttttgaggctgcttctgctgtgtacctggatggtttgtggccacagctctgcccttgaccaagaaatacttactaatctgaatagtgggcaatccacattcatgctcatgaattacaacagagaaccactactaagcaatccaattaatatctgctctgaaaccaaagcagaacccattgctaattccctcatctgccaaatatttatggaacgtgtgagccctactggatggcagtcactatgctaggaactaggcccagaaagtcaagttagaaatggtccttgcctgaaaggaggggtcaggtagacagagacaaactcatgaccaggcaattacaggggatggtgctctaggggctgagaaatcacacagcagggcagcaatatgatggtcttgctttgggggctgctaaagagtgacacgtccatggaaagtgtttctggaacccttttgaagctactttctttttaagctgaagacataagttagtaggccaccatcagacacactaccagctcctttcatctcctttcatcaaatcagaatgacaggcttattactaaaggagcaacataaacatgtccagtgccctgtagatcatctacaggaccctcccgggaagcaaagccaccttccttgaatcccttgaattccttgaatttccaaaatcccagaaaaacagcattttgttctgttctgccttgtatcttttagcagtttgcatatctgtccttgctattagactatagctatatcatatatacatatatatatatatatatatatatatatatatatatatatattccttacaggcaagattttggctttggaatcatgctatcactcaggtgccagtccatggttttggagacagtaagcgctctggacatgtttctgtatagaagtgacttttcttctcttttcgttctagaccctgcatccaagccagcaagtaagtgctgaatctggatgtttctaccactgtctctcagacccagctgtcatggtcccatttcagggccccagcccccctgtcccccaacccccagctgtcccttctgaatcattgcatcggctgccacctgaataaccccacctcaccaccacttctggaaccttggtcagcagcttcctgggcacagaaaattcagagtcctctgccttgctctcaaaactctgggatagaccccagcccacctgtccaagctcattcctcctctctagcccttctgcttgccccctccctctgcctcttaccctctagccattctggatcccttgctgttccccaaacttcctttgatgttctcaaattgctttgttcacactgaactctacccttggccagcttactatgactgttcattgcgtgcttaccaagtgccaagtccgggtttcaggttatgtaactagaggttatataaactcagaagtttgttctggtgagataacacatcctcattacacctaataccctttatgaaccgttagaatgttctttggttaatcattttccccttggaattgagtgacctttactagtgtattgccccacaatttatcaaagcaaagaatccagtgtcaaaaagagaataaggaggaggtgaagagaactcagatctcaaaaaaagtccccccaaaattcatcgtcattatatagcagttctagcggaaataatcactgcatcccatgtttatccccagtgctatacacacggcctgcaagtcttaatggtttcgatacagtaaatagtgctgtatttccttttgtctgagaggatctccctggttgttttagcagtcaagaaaagtgaataacatgcacatttgaccctccatatacttgggcttcacatctgcagattcagccaacagcagattgaaaatatttggggggaacaacaatgaaaaaaaaacagtacaaataatacaaataaaaaaccaatactgtaaaacaactatttacatagcatttacatttattaggtaaaagtaatcaagagatgactagaggtttaaaggaggatatgggtaggttatatacaaatactgtgtcattttataaaaggagcttgagcatctagattttggtatggggaaggagggttgtcctaaactaatcccttcagaataccagggactactctgctagactagcgattctcaaagtatgagccaggaaatcctagggatccccagtaatttttcaggagaattttacaaagtcaaaactatttccgtaataatgttacttgattttctcattgtcattctcccacaagtgtacagtggagttttccagaagctacatgggggatgtgtaatatcacaatagatagaatgcagaagctgacatgagaatccacctctctatagagccaagtactaaagagagatgcaaaaactgtaaaacgatgccactcttctcactacattttgtctcaaaaaaagttacataaaaaggtttgttagtgtgtcatgggtttattcttcttaaattgcccaatgaatatgtctttttaattctgttttaatctctaatgcagtacatatgataggcataatccagatgaacaaaagcaaatgggcaccggggctggaacgttggagaaccgcagtcctaaacaacaggatgtcttcagccccggtcagactaaactcactcccaccaccctcttccctcctgtggccgaggaaaaagactgatataaagcctactttaagaaaaacagttcttcaggcagccaaagtcaaggccctctcttttccccaacctctttttcccatcctttttggagaccatggctggttggaggccggagtgggcggggcctggtcttggagcatcacagggcctcacagagcctcacagagagcagggccagtcccaggagcactgcatcttgggatgcgaggcgctcacaggcctcggccaatgagatgtggctgcgtcataaggggcggccctccaggcggcccaggtcgccaagcctctgacctgtgcgcgggtgctggcagccttgccgctcgctgtgccagtgccccgcaggctctttggcagtccagcatagtggactactacgaggtgctgggagtaccccggtaggcctcgtccgagggtatcaagaaggcgtaccgcaagctggcgctcaagtggcaccccgacaaaaaccccgaggacagggaggaagcggtgagaagattcaagcaggtggctgaggcctacgaggtgttgtcggacgcgtagaaacgcgatatctatgaccgctatggcgaggcgagggcggagggcggctgcgcaggcggcaggcccttcaaggaccccttcgagtasgtcttcagcttccgtgaccccgccgaggtcttcagggagttctttggcggccrggacccattctcctttgacctcttgggaaacccgctggagaatattttggggggtcagaggaactccctgggaagcagaagcagagggtctgcaccccttttctctgccttcagtgaatttccagcttttgagggtggtttttcttcttttgatacaggatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaayrgcawagagcagttrctccscattgacaccaagtaattccagtccacatttgmctttaagcacatctggaggaatagcggactttttttaggattgaaagtgaactttactttcagaacagctgtacccaagaatttataaacactttatgccaatgcctgtctttattgttgggactrcacggataggacctctgtttgtctttcgatcattgtaaatatctgtatgcaatttgctatttattaaacttaagcctgaggcagacaatgattatttcctagtgctaggacagaatgttcatctcagcactttgagccttacctttttccgttgggaaagtgtgagccaggtggtttgctctaaatcatttgacttcaatgttttactgtgtggtggtgaaatctatgaatatattaatactctggcttaatttaatgatggcttttaattgcacataaatgctcgtgatgtaggaagagttgaccattatttagataaaaggttaaacccaggctttataaaagcaggtaaacctggcaaagtggatgcattcgtttcctatcatggctgtaacaaattacccaaacttggtggcttaaaacaacacacgttattctcttaatattttggaggtcatacatttgaatcccatatcactgagctgaaatcggtgtaagaagcatgttccttctgaaggctgaggacagaccttggggttatgtggttggtcaatgatatactaggactgtcttcagccctaacgtggttctccaactatggtaggtcctggaaatgtaaagaaaagcgtttccaaagggccacgcaaaactgtcctattgctgtgcttggggcatatcaaattaggttgatgaaagccaagtgcatctgtaatattgtttgggtgaggcaccatacacacaattgagaaagtacctttgtgttggcacgggttatgccccaaatgaagaccttttggggcatattgccttggggtagtccatcacaaagggtcccatcttctagggtcacctctgaggaaaagtttgcatgagagcaaaagggcaacaactagacaggctgaaaaaaattaagagcagcatgctggtaattttttacagaaaaatcatggcctgaacacatcattaaccaacaaatactgtgacaatgggtttggatatgctctagtaccctcagagtccaatctgcatggaatggcacccaagtaataaacagcaggaaaatggcagtcagctggcaccatcccacaggggcacacggggtctcacactgaactctgaaatcaacatgctccaaggtgcctgggtagttgcttcttaaataataactatacaagaagtatcaaaataagacagactgtcagggcttttgaaaaatgagttcattttttagtgatccggataagggaacttacatgtgtgaagatactcactgagtagtttgctggggatgggtttgcttatggagccgttcaggaataaaaggagttttgaggtgggaggaaggcatgggaacagtttcatggtagttttttgtgttgtaaatcaccactctgggtaggatagaatgagtgggtttgtatctacacaattggttacataaatcccattgttcagtggtcagcaaagagtggcataccagtgtcactcagaggtggatctgtaacaacgctggctagttttaacagttgaaagctaacacaaagttcaaattttgatatatcctagattactgatgtcataaatgggaagtgttccttctacagaagtgtaaagcttgtttggttattgtttgtttgtttgtttgtttgttttagagacagggtctctctctgtagctgttgcctaggcaagatcataccccactagtaaacatgaatttctgggctcaagtgatccttcctcctcagcattcccagtaactaagacaacagctaccacacctagctaatgtttttttaaaaaaaatcttgtagagatgggaatgatgttgacccactatgttgtcccagcaagagcattttatttaaagaatttttagaattgaaaaatcgctttttaaaatgtctcatctcaaaaacataacactgctagaggcctatatgtgggtattcatcttttataaaagggttcgataaatcaggttttcagaatggaaaaaggggcatttcctctgttgcaaagatgaccctcttgagacccctaaaatgaatttcctccatggaaacacttgttccttctcaccaagcacaccgggcaaggaaaggcatgaccctgtgagccccaagagacctggagtcctgtgaccatcacagtagggtccaaaaaaccaaaatgccagatattttttctggctggagttcaacacagctgattttaattcagcttacatcacacactagaaagcatctagaagagggaatgatcctttctgtccatcatcttcttctcctctgattctactttctgtctccaaacaggtagagagacttccccatctcgggaaatcattcacacaacagcttacctttctaggaatttctaattccactttctcatcaactttctcaataaatgcagattcatttccttttctcagactctcctttaaaccctttcagtataacttcaatcaccaccaatcttgtattagtctgttctcacactgctataaagacatacccaagacggggtaatttataaaagacaaaggtttaaatgactcagttccacatggctggggaggcctcaggaaacttacaatcatgacagaaggtgagagataagcaaagtcatgtctcacatggcagcaagcaagagagaaacagagaggaagagttcacttgtgagtgaaggaggaagagccccttataaaaccatcagctctcattagaactcactcagtaggatgagaacagcaagggggaaactgcacacatgatccaatcacctcccaccaggtcccatccttaacacatgggaattatggagattacaatttgagatgagatttgggtggaaacacagagtcaaaccatatcattctgccctctggcccctcccaaatctcatgtcttttcacatttcaaaaccaatcgtgccttcccaacaatcttccaaagtcttaactcatttcagcactagctcaaaagtccatagtccaaagtcttatctgagacaaggcaagtcccttcccccatgagcctgtaaaatcaaaagtaacttccaagacacaatgggggtacagaaattgggtaaatattcccattccaaatgggagaaactggccaaaaaaagggggctacaggccccatgcaagtccaaaaccaggcagggcagtcattaaatcttaaagctccaaaattatcacctttaacttcatgtctcatatctaggtcatgctgatgccagaagtgggctcccacagtctcaggcaacttggacactgtggcttgcagggcaaagccctcctcctggctgccttcagaggctggcattgagtgtctgtgtcttttccaggcacacagtgcaagctattggatctactatttgggattctggaggatggtggccgccttctcacaactccactaggcagtgccccagtggagactctgtgtgggggctccaacctcacatttctttaccacccttctctagcagaggttctctataagggctccatccatgcagcaaacttctgcctggacatccaagcatttccttacatcctctcaaatttatgtggaggttcccaaacctaaattcttatcttctgtgtacccacaggcccaacaccacatcgatgctgccaaggcttgaggtttgcaccctctgaagcaatggcctgagctctaccttggcctcttttagccatggctggagccactgggacacagggcaccaagtcctgaggctgcacacagcagggggagcatggacccagcccacaaaacaatttttccttcctaggcctccaggcctgtgatgggagggtctgctgcaaaggtctctgatgtgcactgaagccattttccccattgtcttggcaattaacatttggctcctccttacttatgcaaatttctatagccagtatttctgtagctggtttgaatttctccccataaaatgggtttttcttttctaccacatggtcaggctgcaaattttccaaacttttatgctctgcttcccttttaaacataagttccaatttcagatcatctctctgaagttcaaagttccacagatctctagggcaggggcaaaatgccaccagtctctttgctaaagcatagcaagggtgacctttgttccagttcccaataagttcctcatctccatctgagactcagcctggacttcattgtccacaacattatcagcattttggtcaaaaccattcaacaagtctctaggaagttccaaactttcccacatcttcctgtcttcttctgagctctccaaactgttccaacctctgcctgttacccagttccaaagtcacttccacattttcaagtatctttatagcagtactccactctccatggcaccaatttaatatattagtccattctcacactgctataaagacatacccaagactcggtaattcataaaggaaagagctttaattgactcacagttccaggtggctggaggggggagcctcaggaaacttataatcctggcagaaagtgagagagaggcaaagacacgtcttacatgaaagagagaaagaggaagagcttgcaagtgaagggacaatggccccttataaaaccatcagatctcataagaactcactcactatgatgagaccagcaggtgcgaaactgcccccatgatccaatcacctcccaccagatcctgtccttgacacgtggggattatggggattacaattcaagatgagatttggtgggggatacagagccaaatcatgataaatctagtgtgacttcatgttgagacagagtcagtggcctcactattgaatacattagcctgttctttaccacactcgaaaattagccttgctagtgttctctaattctctaaggggcatagcaagagtgatctgtgccacagttcccaattcgttctgctccactgagatgacagtgaagttttgagcaatgtagttaacactagagaatatgttcacattgaaaaactggaagaaaagggcaagagtcactatttaaattccatcccacttttcaacattgttacaaatctaataaacacatattttataattgaataactacactgcataagggagaaaatcaccaataaaaaaatcatgtggtttgattttaaaaaatgaagcttagagtgtttggcaataatacctatgttaataaaaagaagtacagaaataaaaatacaaaaggatcaagtcatggaagttcatatgcattcagtgaatatgacataaaaaggctgaattctctcatgaaatacatggcacaccaaggaataagaaacaatattcaggtcccagagtaccacatcaatgaaccccaaatattctggattaaagaaagctgcctttgaaattgttggtaaagaagtagatcccactatagaaacttggagtgggatagggtgggtttggtgatatgttcagcttcacctgagaaacacttcccttcttggacacatgtccattcatcaccgtccccagcttaactgggcttatacgctcacagttttatctcctccctagacccttccacaatttcttgataatttcagcattccaagtagaagacccaattgacctgcaaccaaaactatgccttccgaactctgagatgtccccacatcatgcaccagaccccaaatcctgaccagaaaaatcttttgtcagcacagatccctctctggaaactgaactcagtgtgtaattctataatcacagacatatatcccacgttcgttgctctacttccactgaactgagtcaacctctttaacacttctacttcctgcgagtgcttaggtctcctgtggtcacctctctatcattcgcaagacaggaccactaaaaattatcacattaacaattgtaatttgctgttgcatcatctttcccctgaaaattgtgcaaacaaaaaatccagatgggtcaagtctcaatgtagtgtccctgctccttcccaatgaaggacatgcacaaccatgaagatggtgcctttacaaacgaacagtctccatgagtcacatcagtcctagtccatc

SEQ ID NO: 12469 - DNA, 15545 bp, Homo sapiens
agtctgggcctgtcggcctcctcagcctggctcactcttgctgctatgaggagaggattgggcaggaccgctggcacaaaagttgctagaactcttccagaggagatgggatctagccccaccaggagtttccactgaaaggatggtgctcctagccccctacagctcctctgccctgggataactccttagtgtgtgctgcttccctggaccttccctctgggacacacacatcagggcctctcaggcttgagtgaagcctgccttcttccatttttgaggttcctggtatttaaaaagcaagatgacaaacaggattgaaagctgtggtatattttggatgtttacattgaacaaattaacgcttcaaacacatacaatagagaatgactctgtgcataaccttatttggagacaagatcagaaatgtaatataaggcccttggtgaacttgaggccctggacagataaccttgcctcaatattccacaggcccacacatctaggcatttcctaggagagtgtggtcaggacacctgccccagctccttccccactgtattacctgggcacctgtgaagaaacctctgctggaagggtgtggtggagcctatggggtggaatagggagagattctgggataaacatggggatggggataaactgtgttggctctaggctggctctccatgatggaagactcctgaatagattccaactccactgggatggtagaggaacttttaaatttccagggagagctcctgcttcccagctccagttaggttagaggtggccactagggaagattttccaacctcttccagaccccagccctgggggacctggctgccaggcacacggatatccagctgctggcgagtgacttggtgtgatctctgcccaggagactgccaaggcaaattggggtccaaggtggaggtgggcaggaaaccctgtcttcaaagatgaatgctttgactggcacgaggggaaatagatggaggccagaaaaggctaaggaggaaggaaactgctaggaccaggcaagggttggcttgggagatgggcaggcagtttccctgcccggggaagggtagaagagggacagcagaggacagaccagtgggaaataaggctgcttctggaatatccaggtgtggaatggagccagtcagagtcacaagtgaatcctgcttaactagctgtgtgacctttgtccagttatagggcatccgagtctcaggtcctcctctgtggcagtgactttggtgaggagtaagcttatgtagattgccaggcacagtgctcttcttccatggcttttcctctttaccttggcttcccctctgacttgtgctttccagaaagctgaatgtgttcgttgttgagggcaggtgaggttggagaaaacccaggcttggcaggtagctgagaccctgggtgggtggcagcctcaagcagtgggtcttcaaggtttgcccttgccatattcagggagaagaagggaaggaacccctccatttggcttcccgggtcccagtcttttctcccattctttccccttccctgcaggtccaatgagctggttttttcctcacctgaccccaagacttcctggacctctccttgtttctcctgctacccaaaacttcttgggtgctcaccaattcttcagttctcctctctttggacccatagcacctagattgcctgggttctaatcctggttctaacactggctagttaccttggccaagttctgtgacttcctggagcctctggttccttgtctgtagagtgggaatgttaattgaacttttagcatttacttgttatgaggattaagggaatcccaagaacagtatcaggcccatgaggtgtaaattttggacaaaggcaactactattattgttatttggtgatggccttgtggtggcactagaatgtcaaggacatggtgcctgccctcaagaaacatatcatgtagctcatgcttgaatccagtcaatatcttccggctgactctggaataaaatccaaatgctccatggtagcctggaggaccctatgtgatctgctccctgcccacctctttcacctcatcttgtctccctctcctccttatctcttgttcaacatctacactgtcctttctgtttctcaaatatgccatgctcttttccacctctaggactctgcatgtcctgccccctctgcctaaactacttcccccagaccctttctgtcatcaggtgaaatcctgcatcctcagaaaggcctttcctggctttccaacttaaagttgccctgccttcctctcccccacccccagtaactccctatctcataatgctgtttcattttcttcatagcacttattattatcagaaattatcttgtttccttgtttataatctgtctccccctaaaacgtaagcttcatgaggcagggaccttgtctggcttgtcctcccctgcatttctagctgttagaatagtgcttggaacacagtaggtgcacagtaaatatttggtgagtggataagtgaacgaaggcagccatgactataggacaaagccgagtaagctgaggggcctcctggggaaggctacagccctggactaaagacatgggtttgttgggttcttggttctgctaactctgattctccatgtgtctcccagggtctagactgggttctccttgaaggctgctcctgagcctaggcgtttttgtagctaaaccattatcatctaccaatcagaaagtggtagcactgttctgggggcctccatctgtgccaggtgttcaacctttagttgctggatcatagggaagtatggtaaggtggtgtcccaaggctgaaggaagcatctacttaccagcaggagcagaagtatttcaacattttgatgttcggtgccttagcttcatgtacagtgagtgccgatgagcttcagtagaccctgctgagtcctgtggattcagcactatttcaggagctgaggtctggagcagctaagctggttggcacctttgtgaccatccaggtcaatgttccccccaatccccgcccacccaaacccacccacttctacaattgaagagggaggagcagagagagggctcaagatccagagctggtcattggcagggccaagacttcaaggcagcaggtggagacttgcatatcttcctgagaaggggcggggaagacatattctcactttctgtaagccccaagagcctttccaagccaagattgggaagtgtattccaccacatcttccctgccctttcctagcaggtgcttctctctttcctcagggccacagggacaggaatcccaggaagctctcttcaactgccaggtcaggcctaggcaggtgaagacgtgctgggaggggaccttgatgtcatgtgccatgcagactttcctttgttcctgcctccagccttctccccattgccacccccctatcctcacacccccaagggttccctggaagctgaagtgactcagggattccaaaactagtcacctcaggaggaaaccccactggaaaatgtttctcatgacagggagtcaccctaaggagtcccacaaagctgctactgagataaggacagagggtgagcaagtggggtggggtgggggcatgtggctcagagcacaggttctcaggtcagtcctggtcatcatgggggtgggaaaagccaacccttcctggagggtttctccctctgtcctagagggacaccccaaaggactcttctgaagggcaacgttcctggtgacctaggctgggtcctccctgcagcgtcagcaagtgaaacaggtagttgggatcacttctggctcctttgaacaccccctcctgggcaagggtcaagataggagatctgagccaactccatttctactaccttcttagccctgaggttctgattggtgagagcgagacccataggtatccagctcttctgaaacggcactgcctcctaagatcctgttctgggattgaggttttcccaggagcacgggaagccaccttgaggccatgtctgccagacaaaaggctaggaaagggagctagtgcagtgaatccgaacagcagggctggatacctaagtgggcagacacaccctgtggccctcagcaggtgcagttgaaacttgtcccaacccaagcccaggtgagcaggaaagcattcactgtggggctccccttccattcacagccaactaggggtaggcacggtgtggcacttccatgccaggaggttacatgtggaattggtcagagctggaatgggaaaccagctcagcctctttctttgtgatcttgggtaagttactaaatttccttgggcctcagtttcctcatctgtaacatggggataatagtttccatgtcatggtttcattgtcgggataaaatgagatgatgcatgcccagggcttagcaccatgcctggcacatgtaagtgcacaggagctgaggccagcaggatatggaagggagaggacgtctgcgagtactgggggcagagggtgaggcagtgagagtggggccatgatactggcctcatcactgttcctgagtgcccctgctttcccagccaccacctgcttcttctaagtgccctccatcccacagttccaggtgccccaagactcatcagagcagagcagtttctcccaattttccagattgccctttgacttcatcacttctctcttttggggctgctttgccctaacgcattggaaagattcctctcactgcagtttaagttattcctggttccctttgttgatttcctagtccttggttactagaggagtattttctaagggaaagcacatgcaaatcaagccacatcattctaggggcaatgtctgtgtatgggtatgttgggtgcgtatgggggatgaggcaggccaataggcaagcatgaagagaaggacctggggggaaggacacactggcccactctcagcacagtgtctcccaagcaggctggacccggctgacctgtgtctttggggtcaagcccaactgtaagcctttctggggcacacatacaccctcctggctaacagtggcccatgtttctggacctgctgaggctgagtgggctcacttcatggcctgaaagcagtagctgaccctgtcatgggcttggtccccaaggctctgtgaatgagagcaggttggttcctggaactgagacctccttcctgttgggtcttaggtgaggctgtttcagtttccctcctcttccttgcttcaccttctcatttgtgcaatggggacactcacccacagcttcttccatcagaccttgcccatccagccaacaaacttaggaagtcagggtcttccagcagccctgtgagggtaggcttgtatccccggtggggggcagtgactggcgagggcaagggggagttagggagtgggtcatggacaatgggggagaagtcatagctgatgggggtcatagaattttggggtcattgaaaatgtggaagaggtcagagaacaaaggggatgggagtcaaaggatgtctaagggaaaggaaataatcacgaaggtggatgatcagagggacacctgggaagaggggaatggtgaaaccagaccctggatggggggagcagggatcatggaaacgaggcctcttgaagggaggccacaagacatttcctaattttggctaccaaaccaaccagggaaatcccgctaatgccagttcacaagaatgcagaacagcagactgttattgctttgaccccatggccagaaaaattcaaagagcaaagtttacccaatcagctaccaggcatataatgatggtcatcacaacttccatgagtattgcattttaagcagcctttggaaatactttcagagtttttttggttttgttttttaacctcaagtcactccctaaaaagacagtggaaataaatttgaataaacaaaacaggcttgctgaaaataaaatcaggactcctaacctgctccagtcagcctgcttccacgaggcctgtcagtcagtgccccacttgtgactgagtgtgcagtgcccagcatgtaccaggtcagtgcagagggctgcctgagggctgtgctgagagggagaggagcagagatgctgctgagggtggagggaggccaagctgccaggtttggggctgggggccaagtggagtgagaaactgggatcccagggggagggtgcagatgagggagcgacccagattaggtgaggacagttctctcattagccttttcctacaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagtgagtctgctgcccctcccgaatgcctgccctgtgtgtgctggccagggtatgcgtgagggaccagggcaattccagcttactttcccattttgatctcagaggggctgtaaaggtttgggagttagacaaggtctgtatttgagtcctagctctgactctcattggatgatcttgagtcaattcaagttttcaaaactcagggtttttttttttttcacctgcaaaatgatataatgccccataggctaatgtgcagatcaaatgaaatataatgtatgtaaaagtctgtatttatgttggttctctccttttcttttaaaacatccctataatggcccatgttttttctgggtaaaatattagggaataatggcatgatacaggcatgaagcatcccaataccaattgatactgccctggccatgaatgggttagttataagcatactaaaggagtgaaacccttaacttttgggggcagctggctggctggagctgtggactggatatctttgatcatgatcatgggtactgtattctttcactcagtgtgccacataaatattatagttctctatttgtgccatgatatgaaaaatattaggaagtgctgaaatatgaatgatgaagcaaaatattaaaaactagggtcttagggattccagacatgtgatttcacttcttccttctagttctgtcttagcattggctttgggggtagatggagaagttcagtggtggggagggggtcagatytaactgagattggatctagtgtggacactacaggtcatgactctttggagtggtctcagaagctggctgggtcctgggccaaatcagatggcatgggagcttcttaggggaggcgggtgccagaggttaactcagctgtcttccagaccccttgctgggagtctgtgaacccgagaaccactcaggtggctttccccaaagtgtgttctgtgcaatgctcatcccatgagctgcttctcagaaaaaagtgatgccaggtaaacttgggaaagactgctgtatctcctaccccttggagattcatactgtcattgtacattaaagtctgcaagaagtctgtagaaagtaaaccgttaaactggtgtttcccaaattcatttaagcacccaacaggtgcaggtgatttattagggaacccactttgggaagtgatgtgctagctaattccatttgccagggcttgtctgtgtggggaatggtcccacaagctggagactgtcgcctgccagactaatggagtcgcagacctgtgggacatctacttttcagtgtttttcatctttctttctttctttctttttttttttttgccatgaaatcctttcagaataagtaaataagtcttcccatgcactctcaagtatgcttataatataagcttgcacagcgtctggaagaatgtgcaggaaatagttgaggatagcttcttctggggagtggggctggtagggagagactattaactttcactctttatactctttaatacttggatgtcagagtggtttttacttttgcaataatgctataataataatagaaacaccacctaaagtccggcccggtggctcatgcctgtaatcccagcactttgggaggtcgaggtgggtggattacctaaggtcaggagttcaagaccagcctggccaaccatggccaacatcatgaaaccccatctctactaaaaatatgaaaattagctgggtatggtggcgggcatcaggagaatcgcttgaacccaggaggtagaggttgcagttgagccaagatcgtgccactgcactccagcttgggtactccgtctcaaaaaaacaaaaacaaaaaatcaaaaaacaaacaaaaacacctaaagtgtaatcattacaataagaaacctcatgctgagtcagatagaagcagtgctggtcaatggaggctaaggcaggagcctgctcaccctcccctgcctccctcacggtcccaggaccagttggaaagcactctgtcacctgctaccctcatttacagtggggaaaatttaataaaggagggaggtgacttgttcaaagttacacagcaagtgggttcagaactgagacaagaggccaaggccccagacggaccatttccttcttctggcactcccatgccaccccaccctctctgtttccggcccatctttccaaggcctgacaagtgccgcccccacaggttggacagagacttgaaccggctcccccaggacctgtaccacgcccgttgcctgtgcccgcactgcgtcagcctacagacaggctcccacatggacccccggggcaactcggagctgctctaccacaaccagactgtcttctacmggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaarcctgcacttctgcacattttgaaaagagcagctgctgcttagggccgccggaagctggtgtcctgtcattttctctcaggaaaggttttcaaagttctgcccatttctggaggccaccactcctgtctcttcctcttttcccatcccctgctaccctggcccagcacaggcactttctagatatttcccccttgctggagaagaaagagcccctggttttatttgtttgtttactcatcactcagtgagcatctactttgggtgcattctagtgtagttactagtcttttgacatggatgattctgaggaggaagctgttattgaatgtatagagatttatccaaataaatatctttatttaaaaatggcctaatctgtatttggcatccgtggtgcctgaacatctcgcggtctcccagcctgtcccttctcctttccaccattggccctcacctctgtccaccctgccagctctctccgccctccagagtttccgctgcaccctcccgtcctctcccatctctgtctccctggcccatcccaaacaccagggtgggggctaggccgcgctcccggcatgctggagagacagaggcccattgaggcattgcagcaggcacagagcgcccccttgtcccccaacaatccgcctttgtcctccagtcctggctgctgcagcttggtcctgggggtgctgcctgggctgggctccagctcacaccctccctaaaaggaaatgggagaaaggaccggccaaacaagagggttaaggttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtaacagctgcctcccaacctggtgcctccatctccctgacccccggctcctggccagccttatgccagcccccagctcacccttcagtagcctccttccccaagccctctggacacctctcctgcccgcagctgccccttcttcgtctcctactctgccttcttgctgcctctccacccggagacatttacagcaggtttcagttgcagcaggaaggactgcagttagacagggtgactttttgggacattgaggaagcttgagacatagggatgggacaggggcaatgacagcctctaacatggccacttctcagcacgtccaagaagtctaactatcaaaaagggcagacttcctgcaactgcactttatctgtggtctgctgcccagaaacatctcttctcaggaaaggatcttcccctggttacttagcaagaccacagtgtagagttaaggcctctgcacgtatgccaccctaggtcatcagagctaaaggggctcccagaaaccactgggcagcatctgccttctctcttggcatggaatcaaaggctctggtccttgtcagggggctttcaggcatctgggggtggggaaagcattatgaggcagggggctcctcttggtccctgtggagtcgggtctctgtgggcacaactccaggggctggcattcacactgtacctatgaattactgtgggatagtgctcctgggagccatatggcttggccagactgctggggttgctgggtgagcagagtgggaggccggagactgcccttgaccggcaaatgccctgcaacggtggctcctgacaccaggggatagggagatgtgccagagtccttcctcccctccaaggacaggtagtaggtgccagcctaggggagcttccaaggaggggaaggcaaagccctggcccctgcctgtgtccccttcttggcatgttccacatgctcggtcctgcaggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtgaggaaccctgacccctagcccagtttggggcccttccctctcctctaaatgatgcattttcctttcctccccgagcttctttccatttccacaccacagctgggctttgtcccatgctatgccctgcactcaaaggtgtgctttgactcacactgatttcacagctgcagggccacgggcaatcaggaggaccacatccgctagatctactctcccactcagcaaaggtccagccccagccctggcctggcttgacccccccgggctggcatactccagccgctgtcccctgggttccagccccagcgcctggcttctggtcctggttgctctggttcatctgcttccactccctgggtagcagtgtgagcgctctgtctcttgaatgtgcttcatattgtgtgaggggtatcctatggaggggttcagaatccctcagggtcgggctgctggctagcctggaaaacttcagggtaacgccccctgccttctgaggtcctgttaaccctgcacccctggcccccaggacttcctgcgctgtgtcagtgccatcatcatcttcctggtggtctcctttgcagctgtgacctcccgggacggagctgccattgctgcttttgtgagttcagccctgcaggactccttagcccctcaagagctcaggctggtgcttgcacactttctgtatcagaagccacagccaggacttggggttctggcttgcacctcaccctataccttaacccaatggccctatagcctctgttttgccatccccactcccactcccacaggtttttggcatcatcctggtttccatctttgcctatgatgccttcaagatctaccggactgagatggcacccggggccagccagggtgagtgcctgtgctctgtggagaggagatgccctccccaccctagctacccatcctgatgtgggtccctacctggctctatcctcacaggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctactggtgagtctctttcttccccagaaattaggcaggtcaggaatgtcaaggagtattcatgggaatgttgccagagcaggtcgtggtctgtctctgggactgggtctgagcagtgaggatgtgggggctagccagaagaagctgaagacatcctccaacacaaaacttctacgctacacctctgtgtgcacggccactttgtggtgtgcctggtggctgggcatctggagttctgtgtctgagaaggcacagccttcctcatgggagcatgcatgcaccaccacacctgttcccgcaggttagtgggctggaggccaggcgctcgcctggggcgtgtgcagagctcccccttgtggtgtggggaagacttggcccacaggacgcagggagagggcagcctgaggtatcagaggagggagagatttcccaaaatgcgaatgctgggagagccgttgattatcagctggtccaatgccctcatttcacataagagaaaacaggcccagccaggggaggtgaactcatttgtgacagagctagggccagaacgcagctcttctgacacctaagcgagtgttctggatactgtactgagcctccttgtagctcagaaaagaatggccaactcttccctccactgcgggtccaccctcccagcttgccagctcctcagcacacatttcctgagcatctcccatgcacactgtgctgggtgccagggcctcagaggtgacggggggcctgccctttagcactcacaggctgggaaagagacaagctggtcaagagctccccacagtgaatgctatgggaaggctcaggggagtttggagcagacactgccacagcccgggagtcagccctgctgggccgagacagacagatgtgcagccagacgttcctgcccagcccgaggagcccagcatggcctggctcagcagctccatcccagctgacgtgctatctcctgtcgctgatgtgtgtgtgttcccgccctgagatacaatccttcttctggagcgctccttccagctgcaggccccagctcccaagtcctgcccgaaccctggatcttgaactctggtcagagcgctctgcttccttggtggcagccactcctctctcttggtctttttcctgcctcctgcttcctgttctcctatccttgtgtcctggctcaccatcagaactggcagcctctcctgggctagaaccaacaggattttgtgtttctctggtcactgctcacatttctcagggctttatgcacagtccattctcatggtctcagaggagggatagaagaggctccacttggggagtcagggagatggggtgccaggtgaacggttaaggaggcggtcagcagagcctggctgcaaagcccagtggggagtggggatttgctttgtgcagaacggggtcaggaccgggcctgtcccacaagcagctgtgtgatccaggccagactgtccccagtaggagcttagagagagcagaaatgtgaccacagtgtttccctgtacaggcacctgtgccatctgtgtctgtgtgagaaccaacatgaaatgagcaatgcccaggcttggtcctcatggcatattggtttgggctcagtgttgattggccccagagtctcaagatgccctcacggtgaggtgctgaatcataggaggcagggggagacccctggggaagacagggagggggctccctgggagttacttcctaggggctgactagaatggaatctctcccatctcctttcccataccttaattctcagccagctctgagccttttctggcattggtggaaaattcatttcagaaagaatgggtgtcctaggacacctttaatcattgcagcctcaggggtggggtaggtggagagtggcttcaacttcggcaccaaaattctatctcgtagcatcttggactggctcaccattttgatgccattgttttcttcacttttgaaatttctccctctccacccttgtgtggttgactgagcagaactgggactcacagctgtccacgtcaggcagaacacctcactcctctgcacctcggtctccttccttgtggatatgggatgccttggctctggcagctctgatacaggggctgggggcctccctcctctcaggccccctactgccctgatccaggatggacagctggcaggaaggacagatgggctcaggcagagtttggcactcatatttattacaggttggcaagagtgaggttcccgaggcagtgtcactcctcatcgtgcattttttgctgcaaaaagaataagaggtgtgagggggcagctggcaagagggagaagtgtgtggggacaaatccctggggctttcagaggcctaagggagatgcccttggagggagaggcagggccccagggatcctgtggtcccacgttagaggcacttgtggtttagggggatggaactggggatctctgcagaagttccagtcagtggggggctgttttgagcaggagagtggattctcaggttatgtaagctatgggaccctcagaactgcctacatatagggcaagcagtgcccactctgaagggcacccatatcagggggcatgctaatgtggaagtgactag

SEQ ID NO: 12470 - DNA, 56001 bp, Homo sapiens
acacacatgcacacagacccctcctcagtcagaagagccctgccttcatgatgcaatcaccttctctcccagcctgtgctgtttaggctttctaggtcaaatggattcctcagaggttccattcccagcctccctgtccactcagtgcacttagcaattcccctgaaggcttttaacgttcaccatttaaatttcattcttaccacaggaactgccaggaggtcagcactgttaggtccaatttgcaggtgaggaacagactcagagaggaaaaggaactggtctaaggtcacacagctagtgagtggagaggctcagattcaaacccaggggtgctggccttgggctccctccataggcagctgcagcctccactccagctcaagccccagggaaagggacaggagtggaggcatgggcaggagggtgggaggtcacagtacagattctttactcccaggatttttattatcaccctaaaataaagctagttactccaggcttgcttctcctccccccaccccacccccactataaacctttctatgacatttacagggtggggggcatggggcatagggggagacagcatcgcctgcttcctgggaactcttgtagggcagaacctgactattactgatgttctccaggacctcacacacagtaggggctcacccagggtgggtttgatggatggatggatggataaataggatcatcaagatgaagggcaatgcctgggaactctttagagtctttagcgtctcatcttttaattcagcaaacgggcccagaagattcccatcccttccccagcactaggccctgttttggatgctaaagacacataaatggggaaactgagaccactacttggcagagacacaaaagtttgcagcaattcagaagaggatgtgcctggaatagaaggagaatctcaggaggggcagtcctcacccctgcccacaataatgctgtgaaccagttgctgcttccggctgtttgggccccaccggcagagaagccattgtttagcttggtgcttggcgcctttcctaccacccaatccttccccttcccattgtcctcaggcccctcatcagggtacaggatgcagctgccggcacagcagcaaaaagaatgggaaggggctgggagaagtagatcccaggaaagttgagaggcttcagctggtggtccctttcagaagagctgctgacaaaggccccaggcagcaggctctgccagcatggcactgggcactgggtgcagaactcaggcttcagaggcagagagatccagattcaagccccagtatctgccgctgacatactgtgtgtccctgggcaagtctcttttgatctctgagcaacaatttccttcttggttagaggaagaataagatgcttgcttagtgaagaatgacttattgcattgaggagtaacacaaaaatgcatgatacctaaatatttttaaatgttcatttctgttccttccccccacctcagccatagcaaagtatcaaaaaagattatgtcaaagaggactcttgtgacaagtggaagcagtgctttctcttcagtaaatgaagatgttttcccacaactgggttatctgaaaaatcacattgaacaaatctataataaatcccatttagtaatttataatcacattaatggaacagctgacatttattgagtacttactatgtgtcagacacatcacttctgcacagatactctgtgagttaagtactccagggttaatttcatgggtgtatgaccagagtagctgcacagggccccccactcagaagggtgccatgcacttggggtttaatttcctgtggtcaccaccttgaaattcttaatcattctatcttttaatttgtgtcttataagaaaagttgggtggagcagtggagcacacactggttatttggagccttggttcatacacggtcctgcctcctgtcacctccccacctcctcctccctgagatgggttctcagctgtctgttcccctaaacaccccacatccctattgccaccacaactccatcccaggcaggggcctgggtgtcggcacagggagaggaagagagagtttgcatgccaagtcatgaaacaggcctcttgcctgtctcatgtgagggtctacactcaccttgtatcaccaggcctaagggaatacaacattaaatagtgaataataaacaggaagacaggttgagagagacagcagagagagaaaaggaaccctgcatttgcatttgcactggtcctcataaattatgtagccagtcctgggtactatgattgcctctatttcactgaggtggcaatcatagtggacactgaggctcagagaggctcagtactttgtccaggatcacacagctgccaagtggcaatgttcagacacagacttagatcccaggtaagagaggactccaagatcttaaagagctttcagcccaggaattaggagagctggatccaatttttgactatgaccttggcaagtttgcccctactctgtgcctcagcttgcccaagtgaaagcactctatggagtcttccaaagtagcacagggtctcaagatttggctttgccagttatatgggctgtgattttgagcacagggaaatcatctttgcctaccttccccatagagttgacagaagcattcagcagacatgtacccactctgcatgacacttcacagcatgtaaagcacgcccatgctactccctgccccaaacaacatgaagcagaagactgggctaggaatattatcatccccatatcacagacagaaactttgaagcgccagaactctaaagtgacttccccaaactcactgcatttcaggcaagttttgagtaggttaacagactccccaggatcataatatgaacaaccccaaaggagaagatggatcacaaccttgggagtcctggtgtgggagggcagcaggaggccccactctgagtggggtggcttaatccctggccttgagggtcccgggtctgaggaaggaggccagagaggtatccaagagctcctgaaggaaaagaaacagctggccagtaactttcaaagggtgacagcatcctgtgtgatgtctacccaacaaggaggggtgttatctacagatcataagcaaacaggcagacagaaggactgagaggcagatccagcagaagcattcccctgtttgtcaattctactcctgcagcctccccacccatgaccagcccactggccagtcatgggagagatctccacccacagagagcacaggctctggctgaccagaagtccctgcagcgggggtggtatgtcctcagccctgccccactcccctgggttcctcagtccctggttccctgggaacctgtatcatctacaacaaaggagggccaccccaccctcgggccagccacctctcctgcctggggcttctggtgaccacaggatgtgtttcagaaatggttcttgaagtcaggagcctcacctgtctatccccagtccttcagggaagcattagtgaagaactctccagtaaaactttctgtggtggtggaattgtactattacttgctgcctggtagccacttgccacatatggctactggacactgtggccaatgatactgaagaaccaatttaaaatttgtattttgttttaattatgttaaatgtagatttaaattgttatatgtggccagtttggctactgtattgggcaatgaagctctagaaacaaaaggggacaatacaccatgacttggggcttcaaaaacactttcacattcatctcattgtcctgtgaaataggtgtttatccccattttacagaggagaaaactgaagctcagagaaactaaacggcttccatgctgatggagccaggaagaagtagagacatgattgagtcccaggtttcttgattttgattccaaaagtccactcatacctctttgcaacactgcccacttatgtagtcatcacatatttattgggtcatcgttatttaggagtacacttctgggctagacacttaaaaacaaatcagatacaggcccaggctttgcgagaatccttggacaaaagcagcgtaattgccacagtaagaatatgggcataaaaattactttaagtgactttcttccaagtagctcaaagcactttgctttaaattccatttatatctgatgacttcccaattgatatttcaggccccaacctgtgcccagagaactctcaatgggtataccaaacagcctccatttgaatattgaattggcttgtcaaacttgtcccaaacttgctctaccccatctcaataaataacaattccttgcttccagtgtttccaccgccaaaccctctcttctcttcacacctttcatctaatctatcagcaaaaattgtcagctctgtcttcaagaaacatccagaatgctctccatctctgctactgcctctctaatctatcagcatcatctctagctggactgtaacaaactgctctcctgtgttcctcactccccccccacttttttctacaaagtagccagagtaattttttcctttattttattttattttatttatttatttatttatttatttatttatttatttatttatttatttatttttgagacggagtctcgctctgttgccagactgaagtgcagtggtgcaatctcggcttgttgcaacctccgcctcccggtttcaagccattctcttgcctcagcctcccaagtagctgggattacaagcgcgcaccaccacgcccaggtaatttttgtatttttaatagagacaaggtttcaccatattggccaggatggtctccatctcctgaccttgtgatccgcccacctcagcctcccaaaatgctgggattacaggcgtgagccatcgcgctggcccagagtgaatttttttttttttttttttttttacggaaaagccagagtatgctacctctcagcttaaagcccccagtgctttcccaaagtcctttcagtgatccataaggccctaaagccctggcctctgatgcttctctgacctcatttcctatcactctgctccttgctcttctggtccagccacaacaggtcttcctggtcactccttcctgcagccactgcacagctcattccctcacctctcctccgataagctgactaaatgttcccttttcacagaggcactccccatcacctgaccgtgtttcaattttcatcataacacttatcacctcctgacatttaatatgtttgcctattgttgctctcctccctctagagtataaataaactgcaggaatagattggcagataagatacacgatgctcagttaaacttgcatttcacatacacaatgaataattttttagtgtgaggatgtcccagatgttgcatgggatgtcttaatgctaaaaaattgtttgctgtttctctgaaattcaaactttactgggtgtcctacatttttatttgctaaatctggcaacactatacaggaagacaaggaccctggttattttgttcatggctgtatccccagcgctagaacagctcctgacacgtagtaagtaagctctcaataaatatttattgactgaatgaatgtgttaattaatctgaaacgcgcctaaacttttaacagcctgtgtgagagtcagagaggcggagccttcagacttggttagtccagggggcctgggcggctgatgaactttcgaagtaggtcgagcagccgggcgctttgcctgccccgcccgcgctccgcaggatgcaggactccacccggctcaggttcgcagcaggtcccggaagccctcctgggggcggggccaccctaatcggcaggtgggacccagccccagccggggcagggcccctttaacgccccacctctccgccacgactttcgccccggcgtgacgtcaccccagcgggcgaccaatgggagtgcggcttactggcaggcggcgcaggcggccgctgccaaaggggaagtgatctggggctggagcgatggcccggggctggagctcgcggccgccgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtsggccgagccgccgtcgcccgcggcaccgtrtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcytgctccggaggtccraaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagtgagtagtggtgaaaggtggaatgggaagaaggcatctccttgcactaccaaggggccacattgacaggaaggagaaaggaagtccttaggaagaaaaaagggtgtaggccttggaagtcaaagagggaaaaacggttttagggagaaggtaagttcagatcctgaatgaagaataagttagagatctgtctttaggtgtagaaagaaaagctccaaatctgaggtggaaatgtggacttggagaatgtgccaagagcccagggagtcctaaagaagcaaagaatggagacagaggagcagagaagctttggggactagactttttaaaacagtgtagaacaaaggagaagcagagactttaagactgcagattatttcgtttttgcactcttgatgagtctgaatattggtggtggggaaatatggtgagagatatactgtaggaagtatgagccttgagagtaggtggggtcggggggcaaaagaagaggcatcattttccctagccattcataggtggagagaccactaggcaaatcaagtagtaagatttgaggacattgggattggggctcaggatgggaaaggactaaagggaacttcaaaaacgtcctttgactctctcagagcacactaaaagaaaagaggattctgctgaggatgtagaaacaatggctaggcagaaggtcggggtgctgacattgagtggttggttggtttaaaatgtcttgttttgttaaaggaagagtttgatttctaatgagctttgtcagctaaggctgttaagggcaatcctgggtttgggttatgaagatcagttgaagtgttaccttcatcagaaggtacctggagtagtaaccctactaagttagtttagaccttgaaggttggttgatgttttgtgtgaaatccagccccttctatgtttccttacttctgagccaataagctagaatacaccaggtgtccacttaaaactacagatcctgtttctttcatttcttttgcagtaaaacttgctcaaaagtttataaagtttcagtaaactggagcaaggttccccggagtgagtatgtatttcagagagaartcaataggcaaattmcagtgcagagatggaattgcagagaaacattggtctttacacttttgtgacctgagcttgtattcaaagacctccctcctgataatgacagctgcagtgcctttaggttcttccttttacctgcaggaactccttctgttttatgtgacatttgaaacctttgtatccagtagatgaacccttaataggtcayattatttattcatttaagtgctttrccctgcctcccctggttaattcactggttattcatttaaaggarataattgcatggcaaaacgtgtactattgctaataaagctatacccataatcacttttgtactcatggttgaatttgtcctcttgagcaggggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaagtaagtaagtggttactctctttttttttttttttttttttttttgagacagggtcttgctctgtcgcctaggctggagtacagtggcgcaatctcggctcactgcaacatccgccacccaggttcaagtgattctcatggtcagccttctgagtaactgggattacaggtgtgtgccaccacacccagctaatttttttgtctttttagtagagacggggtttcaccatgttggccaggctggtctcaaactactgacctcaggtggtccacctacctcggcctcccaaagtgccaggattacaggcgtgagccaccacacccagcagtggtcactcttttcagggtgtaatcctggactcctttccaggttctgggacaaagtcaaccctgctgaacgaagatttttgcccattctagtgaagcaattatacgttcctctcagtatttttatactctttttgagctctctgcttgaatgttgtaacacttatttgtttttaaactcacaaataaaaggcagtgcttatgcaccagcaggacaagtagcatctgaaataatggcattgcagtcaatgcttagcgtgcaaaaggcaagagactcctaccctaggggtrggagtctagaacttggtgtaacctctacttatggcttgcatctccccragcataaagtggcaatgacaacactgggctattccttccacctcacagggccatttgagaaagaatgtgggagcatctgtcaaacgattgcctctttagaaggactgaataggagcataggaatgggcaataataagagtagctaacatttgtggaaggcctactctgtgccaagtctcaaatcattttctttacaaaataatccggtgagatgggtattatttttattattttgtgctcttagaaggattaagtaatttgttcagtgattaagtatracagagctgagcgtcctcttgccccttgctgcccaaattcacatttataacactactgtctgcaccactgttcctggtggccttgtaagcctatgcacatttcttcaagtgcctacagatctctttgatatcaacttggtcagtaatctaaaagaagtttagtagaagaaacaggaagaactggttttctgcatacttatcagttttcaagcttagagcaaggactgatagatttctctccttagctgtgcttatactagtaacacgatctctttcaagaaaaaaacatttaaataccattaatgagtgttatcattttaaagttttaggaaacttgaactaagttacatactcgtgaagggcttacaacaaccatacctactttgaacactgtgcaactgtcagaaatgtttatctcatgagtgagttttaaagtttaaggaggttttgaagtcacagagttttgtatattctaaattgtaaagttatattttacacatccaaattactttttcatttctttttctttcttgtttttttttttttttgagataaggtcttgcttgctctgtcacccaagctggagtgcagtggcatctggctcgttgcagccttgacttcatgggctcaagcagtcttcccgtgtcagcaccccacacccccaatcccaatagctgaaactacaggcacgcgccaccctctgctaatttttgtatgtttgtaaaagacagggttttgctatgttgcccagactggtctcgaactcctgggctcaagtgatctgcctgcctcagcctcccgaagtgctggaattacaactttgagccattgtgctcggcccaaattactttttccaaaaggtatgtttgcataatagctttgaccgaatttaacatagaattttttttttttttttttttagcaacactgaaacttttggctctaggtttaagggttaatcttctaagcaaaggaaccagtttcaacttaatcacaaataccctaaccttaatagcatgagcacaccaggaaactgaccacaaggctttctcaaggtcataaagaaatctggctccagaactggaattaaagttcttactttcsatcttaagcctagattacagtatcctcactttcccatctgaagcctagaagattgcaatatcccaacttctcttggctgcctacagttactcaagttttgaacccagcctaagaacagctaatttttagtgtgttaatgatgtttctagtgatgttgcttaaaaaaaaaatactgactttggttttcttctgagtttctgattctggggctggggattcagtatgccacaattctctgccagaatcctaacctggattaccaatttttagagtatgatataagaaacaatgagatatataccccatatttatttttcctcctttatagttgtccttgcagtattgtacagtgtctctgaggccaatttttcctttgtaagtagtaagcataacttggaaattaggttctcagaaacagtgttcaaccataagtaaccactgaagacacctgtctgtgccgtcatctctctgtagttaattgggtctcctaactacagccctgtagttagttaggcttgtagttcagctataggcttgtgctgtagcttgttttgatcacatatagcaattatttatttatatatttcaaaacattgctcaattcaccyatccagggattcctttttctgactgctctgtacctgtgtttacaggatacttatgtaatttatagcttagctgagcttttcrggtaatttctttgggaatgcaaataaagtactacattttaaaaatgtagtacttgtacatataatagacctggcaatcagtcaacaaatatttattgaacacttgttaataccaatccctggaaatactatattgtcttcaggagatgtcaagaattataccctggactgcggaccctgctttctaccattgagccacattcccctgggaccctaactacatttgtcagccagctgaatgaagcagatttggaattgtcagtccagctgttttgttggctttgattcgctacaatagaaatgccagcacctgcaatgtcttcctgacattgcaaagcaggacttcctgagggagggtagggaatggggtgtagtcagtccataggctaaaccatcatagactacttaggagttattttgtgagaaccaatatcttgactaaatggaaccaatcttgttaggtttaaataatctttctttgaattatgcttctactttaaaaaaaaaattttttttttttggttggttggttggttgtttttgagatggagttttgctcttgttaccaaggctggagtgcaatggcatgatctcggctcactgcaacctctaactcccaggttcaagtgattctcctaccacagcctcctgagtagctgggaattacaggcgcatgccaccacatgcagctaattttttgtatttttttttagtagagacagggtttcaccttgttggccaggctggtctcgaactcctgacctcaggtaattcactcttctcggcctcccaaagtgctgggattacaggcctgagccaccacgccctgcctaaatatattttttaaggttaatttttttttcttgtttttcaagaagacagtgggattcacgaacttggataagaccacctgcttgtctggctttaatacctttttgagaaatccagaacttcttgattttatttctataaattttccaagacacttgcaaggaaaggaaggattgctaaaatacctgaaatagaaagcaaagcagataggcttggcctttttttttcttttttttttctcgtcaaagagaaacttgatccttaagctaaaagtactgactggccctgaaactcttagctcagtattcttttttccaaaaccagatacttcaaaaaacctccacagttattctaaggaagattctattctcaaccatccttttctgtcactccactatgaaagacttgagtaaatgaaaagaaatttggaaaagtataaataaatcaggcacctccttttctggccatacagacaaagtagtgacttggtcatttagcacagaagttaaagatggtcttgtgctaacgagggcattagggaatataggtatctgtgacctctaaagtatactagaaaaagtactggtcctaggagcagaaggtttgactttttgaattctggctttgcaaaactagctgtaaaacttagacaagtcacttattctttctgggccttcactttctcatctataaaacataaagatgtatttgtgytaccaaagcactttgggcattcctctgtcataacatcggtcacactgtatagtaattctgtgaccgtgcctggctccccactagactaagagcttcagggtcttttgtatatactagtgccggtgcagggatggacacatggtgggggcttaataacaagttgttgaataattaatacataaaagtttattgcaaactggaaagacattgtataaatataaaatattgctgtcagcaatatgtttactatttgagtggtatatgtttacatttttccatttcctcatcttaaagattaggaaatcaaaagaactaggtaaattcttttgagcattaacatacaaaattttaagttgtttgcttcctttgttggaaaaacatgaattagtaatcagaagttgtttgtttgctacacttcctcccatttatgtaataaaagtacctctacttgacttgtctctcctaaaaagctccaaaccagataatcattgtgatcccctcttggctcatagagtcctcaggatccagaatattttcagggctggtcagctttatgtgtttcttagttaataattgtaacccaggttatttatgtatttgtctatttcctcttccactcctacctcctagttcatgcgtatagactgcaggaaagagagacttcgccccttgccccttcggggtacctgagtatggcagatgtttgttggatgagtttttctttataacctaactgaaaatgtataggaaattcagtgaaatgaatttagactggctggtaaaatgtttytactgtatgagatagatagattcctgtaaaccatgtgtaaatcaagtgctacattaaaagcacctgctgggaactrctgggcaaaaggaaatcagtatgtggaagaaacatccacacccccatgtttattatagcattattcacaatagccaatatatggaatcaacctaggtgtccaacagcagatggatgaagaaaatgtagtatatatacacagtagaatactattcagccataaaaagagtgaaatcctgtcattctcagcaatatggatggaactgaaggacrttgttaagtgaaatgagctgggaacggaaagttaaacactgcatgttctcactcatatgtggaagataagaaaagtttatctcactgggtatggtaactcacgcctgtaatcccaacaactaaggaggctgaggcagaaggatcacttgagcccaggggtttgagaccagcccagggaagcatagcaagacaccatctctaaaaaaattaaaaatagctgggcgtggtggcacaagcttgtagtcccagctactcaggaggctgaggcagaaggatcgcctgagcccaggagtttgaagctgcagtgagctatgatcatgccactgccttccagcctaggtaacagagatctcatgtctaaacaaaataaaaatatatttcaaaaaaatctgattctatagaagtaaaaaatacaacagaggatactagagactgagaagaataggggaagaagggatagggagagattggttaaaggatgaaaaattacagctagataggaggagaaagttctagtgttatgtaccactgtagcatgactagagttaacactagatagttccaaatagctataaggaggatatcaaatattcccgacacaaagaaatgataaatgtttgagatgatggatatgctaattactctgatcactatacattacatgtatggaaacattgctgtgtaccctgtaaatatgtacaattaccatatatcaatttttttttaattttaaagcatgtaggaagtctgtcattataatgaagccctttggcaaacatttttggaaaatgaataaatatatctcatttcttttaattattctgaattttcagtagtaagcttgcttaaaataaggataccaccatcactcctcattttgtgggggatcttgttaaatgtgtttgggttttttatttggttttgtttgtttgtttgtttgtttttgagatggagtctcgctccggccgcacaggctggagtgcggtggcaagatcttggctcaacacaacctccacctcccaggttcaaatgattctccttcctcagcctcccgagtaactgggattacaggcatgccccaccacgcctggctaatttttgtatttttagtagagacagggttttgccatgttgaccaggctggtctcaaactcctcacctcaggtgatccacccacctcagcctcccaaagtgctaggattacaggtgtgagccaccgcacccagcctgggttatttgttgagggttttttttgtttaacttaatagtataacattaactccatttcataccctgcaattatttcacagaacaagcatttgaacccttctgagtacctggctctgtgctggctgctggaaatgcatacccaagttagatctagtctttgtcctcaagcatctcaccatttggtagaggagaccgatgagtaaagttacagtaccacgtgttaagtgcatggtagaatttggagtgaaaagaggtgcagtggtccgagtgtcctggctgttggtgctgaatcttagaaggaatgaactaggccaaagtggtagaaataaagaagagacaagccaagggcatctaggcaaaaaccatagcatgtgcaagggtcatgaggcttcaaaggttagtgtgtcaggaagatcagcttggccacaagtaggttgaagaggtaggtaaagtgatgagaaatgtaattggaagttaagcaaaggtgaaatatttattcaggtgataaatattgattgagtgcttaaaattttaattttaattaacattttaatgtgtcaggagtgttctaagtgtagaagtgaacaaaatagcacatgaacaaatgaacaaaatgtagctgaccatgtagaaatgaacaaaatagtcttggagcttacattttaggaagttattttatatgggtcttttatgccagtttttagttttaaggaagcatataataactaaggcggtctgtggctttaaaaaaaaaaaaaggatgtaggttttattctggaggaccagccattattaatattttattttctatgaaaagggaaaatgctctttaaagaaagaagagaaagcattgtttcaggcctctgccttcaggctggcaaatccctaaaccattcaggagctattgtttcccaaaagaaaggccaaatatcatactatacttcacctagcatattcttttatcttctatttcattttgagttttggggtgatttaagacttaagaaaatactgtttactacttatgaaaaagattaaaaatcttagycctcgtaacagcattcgaaaggtggtaaaacctcccccttgcagttgactaaggtagaaaaagatttaagcatttagaaatataacttataatctcaccttgggcattaatggagtagatttataaatcttaattgactaatctaaaagctccttaattgagctggtcagtacttagcrtttatcatctatgaccagctgtcttaagtgctttgcagccattctctcacttaatattaacagtcctgtgaaagtatattttatcgctgtattacagatgaggaaactgagctctaagaatttgagtaatttgctcaagatcatagtgagtcacaaaattgagattcaaagccaactctttctgctcacattctgttatgatttttagttggctaacttttaaaagttgcattgccagcagtgaaatagccccagttaaaatgggagctttagtgtgaaagatatatatttacataaataaaagaacaatgtcagaattaacttttattaatccatcttctttcctactgtttgatgattttttcatcttaggaccatgagggcactttatgctagttatgattgttcttattttgtctttttagtggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcaggtactaaaagtttgatttttgctgtgtaagctatgaatatttgtttggttgtttagtatgaataggatatagagaattgtaggtatagggaattcatttcagtttgttttactttttgaaatggggttttgcatactgtaatcccagcatgttaaagtcaggtaaaatagttatgcatttaccagatatttaaaatgttaatcctttctgcaaaagaaaataattctactaaatacagcagttgagagaaagttggaagtttcttgaatcaccctttcctacatagtagaataggtgtcagataaaaaaggagtgtcatctaacccccaagaaaagtagataacccatttttattagctaatgagagcttatttcatttgagtttacaaaatctggaaatcatcaacagtagtcattctaagaatagcttaggagtgggtgatggagttggttaaataccttggtcagtcaaataagcctaatacaacataaacttttccagtccctaaattgaccagagttgagtaggcattgattccagaagtgggactctgccagagaataaaggcttattctaaggatgttgatcaagcatcttgtatgtataaggataccatatttgtcacagggtaactatagccccatccctactttttccatttagttaggaaatgtatatgtgtagaaaagaaaagtcaagtaccagatgaatgacacacatgcaaagtgcttaaaaatagatattatttttcttggggctgagaaggtattgtcttgttcagagtagaatcacaaagttcagaatgagccagtagtgacaaggagtgctgtgctagaagaaagtgcttgcaaatgtatctgaagccacacctttcagcaatggtccaggagtggggcagttcagcacttaagaccaatgataaatagtgtggggcagtgacttccaaacttttgcctggaacctgcagtaaaaaatgttttacatcattacccagtaaacgcatacatacctatttgtaactgacataaacgtttctgaaacagtagctcactcttaatgtgtatggtgccttatgacactttccattcagttctatttaatctttcaaaattattcatgaaataattcatgagttacagccktctagtatttaccctctgtcctttacctttggactctaagtaattagagaaaagcaggtattcaccccttttttgcaaaaagkatgggagaaattggccttgcctaaattcacacagcaaattacatcaggtgaaagtagaccacattgaagcactgaaagataatcagcatctctcctggggcaaactggggattccatataggtagccagccatgcagtttaccattctgagaggaggatgataccgttcagcatgaaaaggcaaagtcakctatctatttttcatctcgttcttgtaaactgacattataggaagagtcaaaggggatattggtacatggtgggagaaaacacatagattttcaaatctttggtacatatgttggtttctgagttctctttaaccaggaagctagacacaaagtaatcattttattcttagcctgccattatttttaatgcaagaagcacctgagaaggcagatacagtaaatctcaatgtcattgataggtttttggaaackgtaaacttaagtaaatggcatataatgaaaccagttttatcataggctaattaatataaagaagacttaaggtcaggtgtggtggctcacacctgtaatcccaacactttgggaggccaaggtgggagaatcacttgatccaaggagttccagatcagcctgggcaacaaagcaagaccctgtctctagaaaaaaataaaaataattagccgggcatggtggcgtacacctttagtcccagtaactgaggagtctgcagcaggaggattgcttgagcctttgagtttgaagctgcagtgagctgtaatcgtgtcactgcactctagcctgggcaacagagcaagaccctgtctcaaaaaaaagaaaaaaaaagttaaattcctagggcacatttctggccacaaaaaaaaatcactacacttctagataaagaccaaaacacatctagtattcaacattgaaataaacgtgagcgatacatacatttacaaaagatgaataaaagcaagtaaaatatttatccgtttatttcagcgcaggatcgggtcatgagtggccagagcctatcctgcttagggtacaaagcaggaaacagccctggacaggacgccacccccatcgcagggcttactcatacacacgctcacactcagactgggactgtttacacatgccagctaacctaacatgcacagttttgtgatgtgggagtacctggagaaaacccatgccaacatgaggagaacatgcaaacagacagtggccccagccaggagtcagatttttttcccatcaacgttataaccaaatgacattggacaaaatattattcaagaacctgctataaataggaaagtttgcttctgtcctagggcttcatctatgaaactggaagagattgcagtgaaaccctttccatttcagcatcaatatgccttcaaagatgctgggactgacttatgaagccagcctgataacagaggacttcaccatgagcgcaggcccagagcattggtgatgggaaagcagagacttgtgttgtttcctaagggagctcagcactctctgtctgagtggttttctaaaattaatgttacacatctctgatggtctgttgaagtcagaggcatctgtcctaaaccaaagtaggtagaaaaattaaagtaatatttaactatgtttccatatctaaacataactgtcacttaagatgcttttagtggcagttgttttagaagcaattcaaactggctcaaacaagaagtgttattatatcacttaacgagaactgttcttatcacaatgtaagttgaagttaatataatctgaaaaaaaagccattagtttgaaaaaaaaaaaagttaaaatcaaatcttcccttgaaaaagctttaaattagtagttgaaatctaatttacttttctgttttattcatgaaacctctggttttatactcattccctcttgactgttatagggagtctccttccttgaagacattattcaacaattacctagctgcttttatggagctaggctttggattctgtctaaatccattcgggctgctataacaaaatatcgtagactacgtaacttaaaaacaacaggggctgggaagtccaagataaggcaccagcagatttggtgtctggtggaggctcattatttcatacatggcactttcttgttgtgtcctcacatggcagaacagaatgggcaaacaagctctctgaccttttttttttttttttttttttgagacacaatctcactgtgtcacccaggctggggtgcagtgatgcaatcacagctcactgtgcagcctcgacctcccaggctcgagtgatcctcccacctcagtctctggagtagctgggactacaggcacgcaccaccatatctggctaattttttttctttctctttctctctcttttttcttttttatagagacagggtctcactatttcccaggctagttgcaaactcctggaatcaagtgatcctcccaccttagcctcccaaagtgctgggattacacatgtgagccactgcccccagttccctcaaggatcttataatcagatggaggaaatagaaaagtaaacagttgtaaagcagcctgataagcaaaaagaaataggtccaaatgagtattgtgagggcatttttaagtatgtatctcacctagattggagccaggtgagatttcctagagatcttgaactgagtcctgaagggcaaataggagttggccagctgaattctacagaaagagagaagaatattttaggtagaacattagtgcagttgatcctcataatttatcaattctgtacttggtaaatttatttgtaatctcaaaatctatacttgtggcacttttgcagtcattcatcaacacatgcagagcagcaaggaatttgagtcacccagcatgcatatatacagctgagtttgaacaaggtgacatgctgccttcttggttcagctctcatactgtaaacagtgtctttttcacaatatatttaatgccatattttttatatttttgtgctgtttttggtgatttccatgttcaaaaatgtccctcagccatagtgctaatgtgttgtctattgttccaaagtgcagggagactgtgatgttccctatggaaaaaatacatgtgttagataggcttctttcaggcatgrgttatggttctgctggctgtgggttcaatgctaatgagtcaacaatatgcattaaataagatgtctttaaacagaaatacatatacaacaaggttatgtattgtattgatcagtttaaaaaaattgagcaggccgggcacagtggcttatgcctataatcccagcactttgggaggccgaggtgggtggatcacgaggtcaggagttcragaccagcctggccaacatggtgaaaccytgtctctactaaaaatacaaaaattagccaggcrtggtggcgagcacctgtaatcccagctacctgggaggctaaagcaggagaatcacttgaacccgggaggcagaggttgcagtgagctgagatcgtgccattgcactccagcctgggcgacaagagcaagactctgtctcaaaaaaaaaaaaagtacgagcagaggactcacaggaacctaacctgtgtttccccaaggaacagttgttcaatattcactaattgaatgttttgttgcaagttttctagaacataactaccactaataatgagaattgactatatgtgcaaaagtatagatgaatgaaaacatggtgtgttcagggaattttagtcactcattatagctacagtatggtttggtaaaaaaggccagagataagtaagtcagcaagagccgtatcaagaaggaccttgagtgcccttctcctatagtactctgtgtagctctcttttagcactcagtccaaataccttatgtgatgcttatttgcatatacttctaattgcactagaaagttgtacactgtactctaagccttaagcatgatgataaagaaaacgatggcaatgatgatgataacgatgatggtattgacgataactgccattcattaaatgctttctttgtgccagccattattaggtgcactgcacatgtgatctcctttcttggcttctacagtcctatgaagtaggagrtgttctctccattttacagttaagaacactgaggttcaaagaagttaagtagcttgtccacagtcactcagctgtgtagcaatactaaaagtaaaatattcaagtcctggaagcctctcttctttccagcttcccatgctgcgttacatcttggtagcccctgtaggattcagtaggtgctcagtagataaagctgaaaggatatgatgctgagtccctgctaggactaataatcactcatcattgatgattgtctgttttaataactttttctttactatttaaaggacacttaacttcaaccccaaagcaaaaaagcagcatttccaacttcatagtataaaatgatgtattaagcaaatggtctactgtagctatttttaatttttctaatgaaaagtcatgtaatatgcataaaagtcatgactcatcttttggctggaatatggatttttcttaatgggttctatttaattcaactttttagactctgaattccaaagtgtgacttttctaatgcctgaatctgatctgacattctagaatgcatctgttagagkccagagcaattccagagaaagtaatgggagggtgcctcatctccattttagttacatatataagctttgctatagctttccacagatgttggcattattttactgaagagagaaatgctagaagacggaatccagctttgtaatttatgggttaaatagccaagtcctagggaacagtgggtgatccaggttttataagtgagtaagaagacctaagtgatgtttggtacctggaaagttaatggtcagctctccagagcatgcttttgcagtgaggcagctgatacactaggcatagagtgtttgcagcacagagaaaagtgcagcagcacctcactcgatcctgctggcattggctttcagctgcttcttaactttgggtgaaacggcagctgccarccagtcacactggctttttgtgagaccactaccattcccragatacttctgattagccatgcactctgccatagcctcaggaggttggaactttcagtacctggaagaagagtttttacccaaagaacagcttcttcctttaggatctggccagttgtcagtggaggaaggtgtttgtcccctcaggtggctgaaaggtaacyacataattgataagagtattaggaataactatagtcttgcccttcaaactgatcttgaaccaactgtgtacatactttggggcactaaggaaaacatacctggggcaggaacccttcctagcattttatgattgggcatgttacagtggtctcrgaaagccccgtgagggcatggaagaaagggtcagccaagaaaacccatcaaaccctttgcaaagttatgtggcgtctttttcctgtgtgtgtatttctttctcatcttttgtctttttaaaaatttcttaagtaatttgtgagtggattcttatataaggtttaaactataaaacacatacagaaatcctatgaaaattttccttcaattcccatctctgtgttcccatctcacatgcacacacacacacacacacacacacacacwcwctcactmtctctctctctctctctctctcatgcccccataggtgtccagtcagtaatgtgggcttcatcctcctagttctctatttacaaaatcataatagtttttagtatgaattagcctatgggttaacatgcgtgtgtgtttgtaaataaataaggtcattcaatatatgttctgcagcttgcttttccactgaatatatgcacattcttagtgatatacatttaaattgtttctagtattttgctgttacaaataaggaaaaattattttaaaaaatatatcatgtacatgagctattttataagatttctagacatgaaattgctaaaataaagaatataaacatttcaaattttgatggatattcctagataaacttcttacaagtcttctctaatttatactcccataagcagagcatgaaaatgcctgtttctatatgtccttttcaaacctggatatcattcatatctttttaaaggcatgagtgaaaacctccttaatgtaattgcttctcttaggaagtttatggtttgctgagagtatctctgtggactgaggtttctcacccatcttgtttttaaatgaacagagttacaatgttgatgattagtctggttattctggagtccttatgtagaattgcatgttttagtgcttattaatttcactattaaagaactgtcacttatttgatatttcatctgtaccaggtactatgctaagagctttgattatatgtctcatttaattctcatagcctgtattgatcatytgttccttggttacaaattaccccaaaacttagtggcctaaaacaacagtcatttagtatcttacggtttctatatgtcaggaatttgggagcagcttagcagactggttctggccaagatctctaaggttgcaattaagatgtcatccrggtctttataacctggaggtctgactggggctggaggttcctcactcacatggcttttggtaggaggcctcagttcctcccaacatggacttgtcattctggggctactcgagtgtcctcacagcatrgcagctcccttccccagagtgactaatccaaggagagcaaagaagaaggcataggaccttttgtgacctaatttctaaagttgccagttgtcacttccactttattctsttctgtagaagcaagttacttatgtcaggctacactctagggaaggggaagtaggtttcacctcttgaagggaagaagactatcaaagaatttgtagacatattttgaaaccatcacgtatccttataagatagttgttaaatagttgttgttgttattattattatacccagttactgatgaaaagaataaattcactacttatctagccttatctcctaccccccggcctctgtcttctactctgcttagactagccttctcaatgtccatcccagacacagagtgttaattctcagccattcattcaacaaatgccagtctttgtatcacgggtattgtggaaagtaaaagagacatggtccttgatcatgtggagcttatagtcttgtggaagagagaaacctcaatcaaataaccacctaaacaaatcattgtcactttgagaagtgctatgaaaagaaagtactcctgagcctgttcatactgtgttccctatcccccgatgccaccctcacccttctaacctagaaagaatgcctgcttggtttttatgtataaaattctaacttctctgtcagagtccaatttgagtcctccttcagcgaagcctgtttctttcagcttgcattgatatccttttctcagaactttattcagtatcacgtttaatgcttaattgtttctttaatgtactcttgccttgtctctcagttatattgaaagctccttgaggtgagagacctaagagtttcccttaattcttctatcttccccactgttaacacccagtcccagcaaatcgtatcatctctacttctgctactacctctactaccactcaagtctaaaccaccattatctcttgccgagactacacagatckccttcttactggtctctccatttctactgacagccatagtagtcttcctccaaggtgtctccattcatgtaattatcctgcttacacacccctgcctatcacacctcaagtaaaacccatgtgcttgttctggtttacagagtcctgtctgttctggcactttactgcacaactggcctcaccacctactttgtctctctgtctctctcacatacacacacacattatgagatcctgccacctaaacttctgttctctgaatatgccaagctctttcctgtactgggacttttggtctagcagttccctcttccctgaaataggcttcatccaatcttcatatgattaattctttcttactattcagatctcagtttaaattttatctccttacagaggcctcctcagaccgatcagtctaaaagttgctacccagtcactcctgtcaagttactttattttaatttttttctagtgcttcccactatctgatatttttctatataaaagtgtctgtctgcttgcactaaaatgtaaacaccacaggatccctgacatctgtgttgttcaccagtggtgaataatagggtccagtagtatttgttttattagtgagtggctgaaaattcatcttaagcctctgaacttttgccttctaaaagaaaagagggaaaagagaacttgagttcccgagttcccaggctccttaccagactccctgtctcagaccaagctactactacttactcagggagctttgtttaaattaaattctttgcatagccggacatggtggctcatgcctgtaatcccagcactttgggagaccaaggcaggtggatcacttaaggccaggagttcaagaccagcctggccaacatggcgaaacccctatctttactaaaaatgcaaaaatttgccaggtgtaggggcatgcacctgtaatcccggctactcaggaggctgaggcacgagaatcacttgaacccaggaggcagaggctgcggtgagccaagatcactgcactgtactccagcctgggcaacagagcaagactgtctcaaaaaaaaaaaaaaaragagagagagagaaaggaaaaaattcttagcacagtacttattacaatctgatttcttttctttgtttttctgtcaccttttactaggatgtatgctccatgagagcagagcttcatggtcttgtttgcctctctgctgtctccacaatgactgcagcagtgtctggcacagagatgccaaacatttgctaaaggaatgagtagggaatcaggttctgttttgtcttacaccccccagtgcctaccactgtgcttggcccataacaagtgcccagaaactggtgggtactctgaggccactctgaatataattgctattggtagatctgtgttctcatcctagaatttagaatgggaaagcggtttagaactaagagtctttcaagtgtttcgagccaaactgcaaagcttttagaatattgtctctgcrgcctgaaactgactattacacaggttcccccagttcccattcaagagcgaagtctagatgtttagaattctatgcctaaatagcagaacggaagcctcattttattttgattaaattcctattttaatacatacattgcatcagtcagtgagtcagtgagtatttattgagccccttcaggatacaaagtagtgctctggtagagctattgagtttgaaatattagtcacatttttaaaccaaaaccaaatccccaagtagttgaaagtgctgttcaaattgtcagagtgcagttcctgtagactgtattttgtgagatgggcttttactttatatgttcccacttgggcaggaacaaaagtttggtaaattactgaggtattacattttaccaaaatgaaattttgaagtgatccttcatcattagctttcttcctgtccaattgttgrgggagtgtgtgataattacagcatcttttgagtaatttaagattttgggatcttgtgctgccaggacagggtaaagaataacacttgccttcactctttgacactagtgttcaaattgggcagggaaagaaggggtattattgttgcctcccagatcccaactctatccaaagtactgtctcctttacttctgtgagctgacagggttgcagaaacacataaaatcctagactatcttgacatcaccaaccgtagagtttgtgaaggtaacgtgtcctctacaaattctcatttgttttcattgtttgttactcttttttgttcagatttctctgttgacttctgcagtgaaccacctcaaagccaatgttaagtcagctgcagacttgattagcctgcctaccactgtagagggacttcagaaggtaggtgccatgtgtgggtacagagacttcagaaggtaggtgccatgtgtgggtactatttgccataattctagcttcttataagttttcattgaaagcctagcatttgaaatcagctgctccaagagggcagtaatggagtgtatcactgtgtcctaaagaattcagaacaattttgttttggtctggttagttaggcctttaatttgcaacaggttacctcagctgtgatttatatgggttcatacctttttatttggctctctgagtcccagaattgctctgctggcactcttgtgttagcatatatgggttcgcttttcagcttgctttttcagttcaccactcacaatatcttcatcaaagcagaccaattgtacatgatagttaccctaaatctctgttactttccataattaagaaagttaaaaaaaaaaaaaaaagatgacctggggaaatgcaaaaattaaaaattcaggaaacaagtgttggcaaggatatgtggaacgaaggaaattttcaaacactcctgctcctgctaggagtattaattggtaaaaatcactttggaggctgggcatggtagctcatgactgtaatcccaacgttttgggaggctgagccaggaggatcacttgaacccaggaattacagaccagcctgggcaacatagggagacctcgtctttacaaaaaattttaaagttagctgggcatggtggcacacaactgtagtcccagctacatgggaggctgaagtaggaagatcacttgagcctgggaggttgaggctacagtgagctgtgaccaaccagatgaatagtactcagggatccttagagatggacgggaagagtggataggggtaggaaggcagaagaggtgcctaattcgaacataaagaacatcatcccctgacacaggaaatggaagaagggattccccaaacggtggatatcaaatctaggatctttgaattataaaaatatgtgctaagtttggtcagattatgtgccagggtctatgagcatatgaattctttccacaaaggagcaagaaatttctaagccataagcgaagacaaaatttgctattttatagccacaccatctgtgtgtgctcagtctccataatttgctacttgtccaatgtggccatctacttacaaattcggggggaaaaaaaaggggtagggacaactctgatgaggccagattcttgccgttgttcctagggccaattcaggaaatgataggcttctgtagccattagtacagaagcagctctcacagtcttgcattagaaaaggaaactggtttattcttttttttattacactttaagttctagggtacatgtgcacaacgtgcaggtttgttacgtatgtatatatgtgccatgttggtgtgctgcacccattaactcatcatttacattaggtatatctcctaatgctatccctccccccaccccaaaacaggccccggtgtgtgatgttccccttcctgtgtccaagtgttctcattgttcaattcccacctatgagtgagaacatgcagtgtttggttttttgtccttgcaatagtttgctgagaatgatggtttccagcttcatccatgtccctacaaagaacatgaactcatcattttttatggctgcatagtattccatggtgtatatctgccatgttttcttaatctagtctatcactgatggacatttgggttggttccaagtctttgctattgtgaatagtgccgcaataaacataagtgtgcgtgtgtctttatagcaacatgatttataatcctttgggtatatacccagtaacgggatggctgggtcaaatggtatttctagttctagatccttgaggaatctccacactgtcttccacaatggttgaactagtttacagtcccaccaacagtgtaaaagtgttcctatttctccacatcctctccagcacctgttgtttcctgatttttaatgatcaccattctaactggtgtgagatggtatctcattgtggttttgatttgcatttctgtgatggccagtgatgatgagcattttttcatgtgtctgttggctgcataaatgtcttcttttgagaagtgtctgttcgtatccttcacccactttttgatggggttgtttgattttttcttgtaaatttgtttaagttctttgtagattctggatattagccgtttgtcagatgaggagattgcaaaaattttcttccattctgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatggtattgcctaggttttcttctagggtttttatggttttaggtctaacatttaagtatttaatccatcttgaattaatttttgtataaggtgtaaggaagggatccagtttcagctttctacatatggctagccagttttcccagcaccatttattaaatagggaatcctttcccattttttgtttttgtcaggtttgtcaaagatcagatggttgtagatgtgtggtattatttctgagggctctgttctgttccattggtctatatctctgttttggtaccagaaaaggaaactggtttattcttgaatttattcattcaataaacatttgtggaacttcctccagtatgtaccaggcactttgctgttgatgggaatactagtttcagagttttgctccagagttcacatggctctgtcagttgcttccttaggggaaaaaagaaaagaaaaaaaaaatccttaaacaagagcttactatcttctggcatcccaatgggttcatacatccagccagtgaggattggattcacaaacagtaggtgtctttgaatgcctgtagcttttgcaacaggcattcagagcttacatagatagcaacagagcttacatagayagcaaaccagcttagatacttttacccagtgtgttgtctctttgcaaatctgtgtgtttatcatgccaggcactgtgtttctttcaagtggctmagttttgaagtggtaggtcatgccaaatacctaactttattgtatctcatgtaatttttattagtgtcatctcgtgttctcttggattcttggatatcagtgtaataaaaatgaccttggttaaaaatactaatgtggcactgtaaaactgtcagcatgtcttgaaaaggccaaaactcactgaatagtaacacccttttagatgttcccttaggacaggctttttttaaaacatggcttctgaattatatctccaagttccctgtccacttgggctttttagggctaatgaaagcaaagtaagccactactcatatccctattcagtggttgctgacaggattctacttttttttcatctctgcagtattgagtttcccaaagccagatatggttccctcccacttttgctcgaagtgtcctttgctcctaacaagtggcagtctactgtgttagctcggccatctgccttcccacagcagggattgacagaggcagtttgtgagagaaccttatccctgggttccagatttataaactaatattttttctttagggaagatttggttttcctctaggaaaaatcatttaaattaagaaaattacttgtttgattgatagaraaagagtmctgttaattatctcagtatacactacatgtaatcatagtttgaagatatttgaaataatcagaaacaccgattttcattagggcagtgtttcattagggcaatgtaaattaaaatcacaatatacacttccattagaatggctgaagttgaaaagaatgactgtaccaatattggtacaggattggtgaggatatggagtaacaggaactctcattccctgctggtgggaatgtaaaatggcataaccattttagaacattgttgggcagttttttaacaagtgaagcatagacctgccatatgatcagccattcacctgctaggtattatggcgattagaaagcatatgataaaggggaatgtctataagtccacatgaagacctgaacacgaatgtttatagcagcttcatttgtaatagtcaaatattgaacacagcctaaatgtccatgagcagggggagagataaactgtgatagagccacacaatggaatgctgctcggcagcctgccaagtagcctcaacatggatgaatcccaattctgctgagtagaagcagccacactttaaaaagcactacttgctcactggttctacttatataaaatctagaaaatgaagactgatttattgtgacagaaagtggatcagtggttgcctgggaacgatcggcaagggagtgattacagagagtcatgaggaaactttcagaggtgatgagtgtttattatcttgattgtagtactggtttcacaattgtttatgtgtcaaaacattcaaattatacatttttgaatatgtacagtttattgcatgtcagttgtctcttaaagcttttttacaccttcctatatgtttccattcagagtgtagcttccattggcaatactttaaacagcgtccatcttgctgtggaagcactacagaaaactgtggatgaacacaagaaaacgatggaattactgcagagtgatatggtaaggagacccagcaagtcagcatgctcctgctcacccttttttgtgtaagagtcatgttgccaactttccactaatctgaaaaggccctgctatgcatctgttcaaaagatctaataagcagtatacattgattgttctacaatttgttaataaagcaattatggtagataaaattaaaagccaaatcttktgcaaacatagtactggaggaggtaaggtaataagacacagttcstgaggatggaatgggtaggacagaaaatggaaaagaaggaaaggaagtggaaaagtgtctcattgtttattactacataacaaagcacccccagaagtttgtggcttaaaacaagtaattatttctcactattctgtgcatcaggaatttgagcaaggctcttagactcccaaatgctgaaacatgtgctcgtggatgaaaggcaggctgtctagcatgttccagctccagccaggctgtcagttaaatgcagcctacaacacatggaacagcaccacccccatccctcaacccccagctgagcccagtcaacccacagaatcatgagaaatacttaattgttgttgttctaagccacaaagctttgggataatttgttaggcagcaacagataactgacagaatcaaacccctgcagtgcctaggaattgttttcaaatatctctggatcacttagtgctgctgcagatgtaagctgtctgcagtcatttggaggccttaatcaatcacttaatgggtgacagccccgtgaaggatttatgaagagtaaaaaaaggatggtgcagcccttgccatcttgctggggagatgagttatatgtaactcatctgaaatcaggactattcaaggcacacaaaagttccctagtctctctgccaatttctggatctgccctcccacccccacctgctctttgcaagcttcagaatttcaagtttaaattgggaagtttgtaccaaggagacctgggctatattagagagctctagaagagagtttttttccattttcttcaggactggcacacctcactgttacttagtggggctaacccagaggaaaaaacattgatctgggtgtcaagacccttggttctggttctaactgccgctgagtaactgtgtgacccatagtaacaaagacccctctaattcagcaattcttttattattttaatatcttgattatgctctcaagtaattcactattttctaaaataatttttcctaactaaaaaatttcctgccttctagaaccatggattcccccctccttctctcctccttttctctttattgttgccttttggttttcttataaaaacagggttgatttcagatttcaaggaaaacaacttattttcaccagttgcattctgttataattaaatctacttcttttaaatttccatagctgccaatggtaatcctcctactgtcattctttgtgctagataagtcatagttatgggctctgaagggttaagccatgcaaagttttcctcactaaaggaaaagtgtatataaacatgttatacttcagtctctggaaagaaacttgagcagtgggaagggaatgggaaaggaaagataaccctcaaacataagtcttacttagcataatgctataagggaaaaactaataatgcacatgattggtggttatgctaaatgcccaagccagtggttacatgactggctgcctttttaatgtcaaagctcttgagtccagtggaaacaatgacacygtcccaggttgrgaccgagttggtccctggaaagttacagtgatgctatagtttctctgggagcacaggcaatggggcaaaggagaaatggtttctagagagttcattcctttaagagattgagaaatagactaggaggatctcagttccctaatgtaatcttggtgctgctggcctagtgcatgctcaagctgggttctctcagaacctagcacaagactggttagcctgtacattccctggcaatacttactgrttaatctgtggatgyattctgggggaggctagaatgttctaggacaatctcagatagttaagtagacctaataattccttgttgcctacactaaacttctttcctcttaacagaatcagcacttcttgaaggagactcctggaagcaaccagatcattccgtcaccttcagccacatcagaacttgacaataaaacccacagtgagaatttgaaacaggtgctttttatctctggcttaactccctgtgaccacagtgcactgcagaggcagccaaatagtttgggcttagtgtttggtgtctcagcaggtgcatcctgtatttatttgcctgcctgggagctgagcagagaggaatgtgtgttggtatctcggggatycatattgctgtcctttcccttctttggcactttgcagtttttccctgcatgtcagtcagtggagtaaattccttttcttatcttgaaagacatagaatgagcagattatcctgaaactctttatgaaaaaatagctatctgggcaggttaaagatgaatggatagctaagtaatccagagtgatggctattttgagccacagtaaattctaagaatgttagaaagcatatccttgaaaatcaggattttctaaagtctaaagacgaaaaggcaagagggggaaaaaagactttgagttcagaatcacattaaagagaatagaggaaatcttcactcagaagaattcctgtcctgagtttaatgccctttaaaacctatagttatcattctttttaaagtagcaatcagtactggaggatgtcagtaaaaataattgaatcttatactaaacaatgcactacttgttatggtattgttacatgagccaattcagtaatcggtattgttcctgaggtaggtttgttctgacaaattaggttaatggacctttcatttaataacccagcaagcctttcctccagcaggtgaggtaaacattggggaaatcaattcccaagctctcagctttctgggaccaaagagtgaatcatgtaggtagtcctcttccctctttccccctcctgtctagctgaggccaaacaattccaaaaggagcaatttagagtgygagggacaaagcaaagacagacgattgatggtcaaaaccaggaaaaggagtttacttcagtacttgacatagtaatggttgttcggtgctgctggcctrcttgtctaatttacrtctttagtggattccataactttatttatttccactctaggatatcctgtaccttcacaactctttagaggaggtaaacagtgccctagtsgggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatggtaagccttttctgatcttttgtgacatgcagtgtgttttgtctgtgcatggataacattctaccaccttttgagaacagccttctggcatatttgagaggccacacatttgtgttgtgcttaatcctcacaatgtgttgtctcatttaatcctcacactagctgtgtgwtgtgaatggccaggcagtgtttgtcctgatttggagagggagatgcggagaggtcgagtcgcttaccaaggcctcaccactagttgttgkcagagatgacaaggctactgtcatgttaccagtgcgccatctggtagggaagtgctggcacgtatttccgagggccttttgggtcttttcttttttaagttattaggggtgggagccatgaaaatgatagtaaccaaaaatcttttatcatttctttaagcctgaacttggctttcatatttatcctgctgtctatatattaaggggaaccttttgcktatgtcaggaaacagatcaggtcagatcagctccccaacttaagaggtcattgagttcacctcctcattttacatgtaaggaaactgacctactaagtcactgatgctggccgactgtgcacggcttactgattttcatattgttgtgaataaaatgtgcagtttcacataaactttgtgcagggatccacatggattctttttttaataactgcagcccccacccttaaagatttcatatagcaaagacacaggcatatatttaaaaatagaaaccaaatacaggaaattgtgccataaattcaagtaaccaccaaagctggaagtaagcccacaaataaagtcaaactctggttcatggaaagcagcatttgaactggctctgccacagtggagccttggcaagttgcctggacttggctttraagggtggagttggaagacctgttccccctcctgctttacagagttgtataatttactacaaagctgtgaagattaaaggagctttattttacgaagcccttttgaactcagctaaactaggttggctaagaattttggatgatgagtattatgccttgaaagttttcaaggcttattgtgaaaacttaccactcctaaactctctttactgtctctgccctctccccctactttatatttctccagcagagaaaataggtaatagtatccatctgtcctactgtttcttagagcagtatcgtgctcagcatggtattttgagtaaaagttctaccaccttttatccttcaaagccttaaagtttgtgactgaaacagctagaagcactagtttcaacttcgtctctggcctttctccctctctcctcccatctcccactcctctgcaatttctgttgagagtgttctgagatcctttaaataagtttgackaatttgtttaaaagtgctaggtgttcaagttttaatgtttgcctttaatcttccctttgtttgtttgtttttgttttgccctttaagatgggtgatagatctgccactcygaaaagacagtctttggatcaagtcaccaacagaacagatacagtaaaaatccaaagcataaaggtaaataatgggaggcttaccctgaagtaaaagtaaatgcagcagcatctctgtgcttttgatctactgctactttttcaaagggcgtacttttgttctcatgtgctgaaacttcaaaacaaagcaattagtaaattagtatgttagtgaataaatgaatacttttttaggcacctaccctgtgccaaacactttagtaggagctggggggaccatagtgagcaaggcagacatgtgacccctattgtggtggagctcaaagtcctgtcagtcagaaaatcgttaacacataattgaacaggtcatgaatcatgagtatgataagtattataaaggacaaatacaggatatgataagatcaagaaggcttccctaaggaaatgacttttacactaagacagtaagttatctgtactaatgatgggggacagaggcagagataatctaaaaatggtgtctaatctaaaatttatttcctatttttgtattgcaatctctatgtattcatagtccatttaaacctcagccagttcccttcaccttgtaccttccccttttttgttcttcctagacatactgtcaagacagcaatctatgatatgctttgatattccaggaaagaaagtgtgrttacagtattctctgattagagtgttaaactctgggctaagataaaagaaaagccaggaagattatgaccaagtgactaaattaccatctcaaatgcatattatgtttgagaagttgggaggatctgaggttcagagaaaatgaacttgaactggaaccacacagtaaaggcagcttttgatgtaatgctttatatctttatttttcctaccttaatagttttatattatctagataaagtcacaatatattaaggttttaatgcatcataagctaagcttttgttgagttttctaactgcttctgcagattttttttaaacctcacctagagaagacagaaaaacttaagagccagatgtaaattttgagcacaaaaaaactaataggtggtttctattagaaagtagtagcaatttcagccacagttcacattttaacaataaatatcagaacacaccagtacacatgtatacataaatttcatcttggctttactttcaggccttttttgtttttaactgtcatcgcagggtatcagttcctttgtcctacctcatccaaacatcctaaccagatacaatttctccttaccattagttcttcaaacatttagtacctagttttcactacatatgttcatattttagctccctaaataaactgagtgaactactatacagtaactattagagtagaaataagatggggcaagagaagttaacaattacttatacaagaaaagtaaatcaataataaaataaatgtgtaatgagttggtgttctaattaaacataggatcaggacctttcacactcatctaagcagttagaaatgagcctcatagaaaccagatgtctctctttttataattaaatgtatttgtatatgccactcttgatactcctgggaatgaggcagggtatgggcgaaaaaacttttttaaaagatacgagcaagcaagactttgaattagaaatattacagctccttctttatgtcttaacagtttctgccaccagttgactcatcaccagggagaaacagaggaaagatcaggggaaaacttgtggtttgtttttgttcagttgcttctttttgtaaggtggtaagagcatgaaattctgcctaaagtggtctagtcacaaggtgaagcaagatatttcggaaagttatttagttagtgtgaaatagctcctagaaaacaagatcctgctyatttaggaaatgggtgtcgcataggcacctgagcaagggtacatttcctttactgctgacacatgcattccttcccccatcaaccaaatgttcacagtgaatcagatcatctgtagcataatgttcccttaatggtttcaaatccagcaagatacttatcagtgctgaggaccaaagacatcaccagtatatgttgattcattcttttattgtctttatagggaacctactgagggtcaaacactacatgctaaacaggctctgggaatacagtggacacttagatgaagtcttactaccaccttaaaccttctataatctttgttttgtgcagaaagaagatagttcaaattctcaggtatccaagctaagagagaaactccagctgatcagtgctcttacaaacaaacctgagagcaacaggcctccagagaccgccgatgaaggtgagagcagagccggcttcttaatatttcatggaggcttgagcagcttgcctctcacatggggagcagggaaggtgttccagcagtactgatcgcaccaagcgagtgatgcctgaacgcaccragatgaagctgatacactttgctttcatttagaaaaggcccattttgtacatgatttgtactctagtctattaagggaagaattggtaatgtttagctggaaatagaattctccatgctgtctgcatccaattataggcaaaaatgttactgtcatagagtatattaagccagccctaaaagttgtttatgagagtcttttcctttctgtaagtgcataacatgtatttaaaaataaatattcgyccttctgaaaatcgttaacaaaaataatgatgggatctttgggttggaagggtctttggctttaggtatggacctgtctaatcaatattagcagatacatgagcctccactgatttagaccctgtgaggacataaccaaggcactggactgtgttagctttgaccttttcccccacacaagtatttttctattttagaaaagcagtacaaactctcttgaattctcctttagtaggagacagaactgtggtggaatgtcttgtcctaacattgtgctacatcatcttacggttgcactcttagcaccagcttagcgggtggcacatacccctagactggstttaaagcacatctcccaggatgtcaagatctttgatatccagccactgttcttgccacttgacagcttaagctcttaccatctaaacatgtttaatgctagcttgtactgtaagatcttctaatgggactgctgctgcaaaccttaacgtaatataatactgattggtgttcccttgcccacaaatatgtctcaatccaagcctttaacttcacatagtcactatgctactttatcttcaaatgtttctctaaattaattgtatatccaattttcctaaaaggtgaccttcgatactagtttaatttggtgttagattcaataatactaaataaaaccttatgtatttgttacagagcaagtagagagtttcacatcaaagccatcagcattgccaaaattttcacagtttcttggagacccagttgagaaagctgcccaactaagacctatctccctaccaggagtttctagcactgaaggtaaatttttataccacggggtagtaatgggaatgttcaaagtaataactttttaatgtttattttcacttgtcaaaaatatatatgatctaacatttattgaggagatatcaagtgccagatactttatatgcattatgtcatataatcctgataaccatcccatgaacataagtatttatgtattatacccattttactgatagggaaactgcctaagtccacacagcaaataattggttgaaacagaatgcaaaccaagacagtctgatgccaaagcttgtgctttttttttagacccccaggctggagtgcagtggcacaatctgggctcacagcaacctctgcctcccagggttaagcaattctcatgcctcagcctcccaagtagctgggacaggtgtgtgccaccatgcctggctaattttttgtatttttagtaaagatagggtttcaccatgttggccaggctggtcttgaactcctgacctcaagtgacccacctgcctcagcctactgaagtgctgggattacaagcacaaaccaactcacctggccgaagcttgcacttttaaccagtgtactatattatctttctgttaatgttttttagggtcttcattcactgagtgcctcattaaacctagtgctaagcaataagaatacagtataagatatggtctcattttctttcttcaaggatattacagtctaatggagaaggcataaaagcaaatacaataccatgagattagtaaaataaagtaaaagttgaccctgtttgtcagggccctccaaaaatgaaggacccttttactgaaaatcagcaaaatattagtacaaaggatatgattcacagaaaaatgtgtttgcactgcttccagcagtgcatgttctatccctcatggtgatgtttagtgcctcccgwttttgtattagctggctgcctggcaaatcacttgctcctgtccaccacaccttcctctggctcttctctttagcctagataccattctaccaggaacatttccttacctccagtgactggattaggctcctcctgtgtgctcttaaattttgtttgcccctgtttagcacatgtcactctgttggaatttcctggggagatacaaaatataacttcctatgggtaaggactatgtcttgtttactcccagcccctagcacagtacctggtactcctgaatatttgttaaataaatgaatgagttacctacacattrcaattaaatgcttaaagcatagaagacttaaatttttctatcaccatttaaatgtgattacttttcttccctgttcctgactttttttttttctgttttctggggaggaggggaagtgttgtgtttaatgggaacacaagcttcctgccactttccattgttaaatcaatatttgatgagaatgaatgggggaargctattaggtcagagtaaggaatagcagtcttaacacttgtgcttcagtcctcagcataggccttaaatacttttggatgactatacttttggaatgacctgaggcagcaatcatatttttatttgaatactgctaccaagtgcgtagtgtagcatgttgtataaactcatgccacaaaaaaaaagaaaaaaaaaaaaacagaactcttcagctagccacttggtgtaaggcattgggaacaagtgtcccactgctttcctgcctttcagagagcttttgacattttattagctgcattgctgcacctattgtaggagtgagagtagggccctattcaggagcttgtttataggagctccttgatggactggaccttgcactgcaactgttttccctcccttcaagctatttttattcttcctgaataccaaacatcaagaggcctattttacctaggtatggtgtggaataaatgatgaaattaaaggagtttgggaagatttttaaagaaacataaagctcattgaccttctttggtattagatattaaatcttctatttgattatggggacacaagtattttttaaatgttatgtatatacggccaggtgcagtggctcatgcctgtaatcccagcattttgggaggccaaggcaggcagatggcttgagctcaggagttcgagaccagcctgggcaacacagtgaaatcccaactctacaaaaaatacaaaaattagccaggcgtggtagcgcacaccctgtaatcccagctactcgggagaatagcctgagcctaaaagtttgaggctacagtgagctgtgatcatgccactgcactctaacctgggtgacagagggagaccctgtctcaaaaaaaaaaaaaaagttatgtatataactgaccttcctaagtgtttgtgatgaggcccttgagaaaatgccagaagaaactattgatagacattctctaatcattttggctcaatattgccattgarataaaaaagatacagatcaactggtaatattgctctttttctttttactgatttttaaaaagtagagagcatgcactttggagagataattcctctggttcttttttattgaaatacaattcacrtaccataacattcacctttttaaaatgcagtgtttttaatccagtgttttttagtgtattcacaaggtcatgcaaccatcaccactatctaattccagaacattttcatcacccctcacagaatctctgtacccattaaacagtcactcccagtcccctctcctgccagtctccagcaaccactagtctcttaatcactatctctatggatttgcctatttggggtgtttcacataaatggaatcatacagtatgtggccttgtgtgtgctttttctttcaatatgattctttcacttagcataatgtttttatggtctattcatgttggagcatgtatcagtacttcgttcctttttatggctgaataatattccattctgttgacctaacacattttggtctgttcatccgttgatggacatttcgattgttctcacttttgggctattaagagtaatgctgccatgaacattcatgtgcaagtttttatgtaaacatatgttttcatttgccttgagtatatatatacctaggaatggaattaatgggtcatatgatagccctaactttttgaggaactcctacacttttccagagtggctgtaccatgttacattcccatcagcaatgtgtgagggttcaatccactttctccacatcctccctaatgcttggtaaggcctgtctttttttattatagccatcgtagtgattatgacatggtatctcattacacttttgagtcactggttcttgagctgcttaatttctggatccagagagacaagtgtcacatagtagaaagagcactggactaggtaataagaaatttgtattctaggccaggtgtggtgtcctagcactttggggaggctgaggtgggcagatcatttgaggctaggagttagagacctggccgacatgatgaaaccgcatctctactaaaaatacaaaaattagccaggcctggtgatacacacctgtcatgccagctactaaggaggctgaggcaggagaatagcttgaacctaggaggcagaggttgcagtgagccaagatcataccactgcactccagcctgggtgacagagtaagactccmccaaaaaaaaaaaaaaaaaaaaaaaaaaaaaaacaggcgtggtggttcacgcctataatcccagcactctgggaggcccaggtgggcgaatcacctgaggtcaggagttcaagaccagcctggccaacatggtgaaaccccatctctactaaacattaaaaaaaattagctgggcgtggtggcgggcgcctgtaatcccagctacgcaggaggctgaagcacaagaatcacttgaacccaggaggcagaggttgcagtgaaccaagatcgcgccactgcactccagcgtgggcgacagagtgagacttagcttcaaaaaaaagaaaagaaatttgtattgtattccacttaagagttacatgaccgtaggcaagttactttcctctttgagctttggatttcctgtcaaaactgagaaagctatgagtgtttgggattgttttatgggcttccaagtcattcctccagtctccactcagccatccaacaagaaatctcacaatatgccacagtctgttttatgagctagctcctatcacataactcattaggcctctgcattccttttcaccccttcaacataagaataaattcaggaaaatctaaagggaagacgctggacagagagaagatgagaccattcattctcctgcgattatctgtcactgcttctactttggcagtgtctcactgtgttgcccaggctggtctcaaattcctggcctcaagcaatcctcctgcctcagcctcccagagtgttgggattataggcrtaagccactgcacccagcctttttttttttttaatatattyttaagggatcaaaaattagtcttcctgatttagtgaaatcctaaactttaccatttggaaacaaaatttgcggagtagcttttcttttagtgttttaaattcagttgagactacttttaactaaatttagctgtatgtttagacgtatacattttttgtaattcatttttgacagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctarcaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggyatccctcaaaggcccaggcgctgccagggggtttgtcctggtagctggaggaaccgatttcagggartagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttcccmacccacccacttaagtctgtcttaaagccrtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgttttttttttctttayatgatgttcagcttggtattaaccaaacttaaattttttttccagaagtattaaaatttagtyaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactragcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtawtcctgagactttatagagcgtgtattgtttgttatacgaacctaacctaccttgttgttttctcatattaagaaatttaaatctactttkttttagtgaagctattttggtaatgtataagcaattttggttctgtttagggagaattcagggyttccatgacttgatttgagctttgcatatttcaaataagtaacacagccattttaatttagctaaataaaaaaatttcttttttctctcaatgtgtctgactaaagcctctctcactcccctgcgatttttaagggaaaaaaaaaatctgctttgatttctatatttatggacgccttacaccttttgaaagcaaggagtaacacatggtgggcccaaagtaattaagagtctgccttaaggactgcaatatttggcctgaagaagcaaaggctgcagggttcaggctttttgcatccagaggatgggaggggtgaggtgaggcaggagtgagccctgcccctgtgtctacccgagatgctccacttaggcctgttttattttttgagagtcaatataaaagcgtgtttgccataaatgtcccaccaccttaaaaaaaaaaaaaagcttaaaatccgttgctaaagaggggtcatacacaagctaaaactttttcacacacagaaaaaaataactctacatgtttgctagattctggatacctccccccctccccgcaacacagaatctggtgaccttccccctcagtcattatgtaaatgactatacataaagcttttgttatttacaaatataatgagaggatttgttcatttccaaaaggaaagggagaaacacatatcctgtgatagagctgggctttcttacctcaaaactgcagccaaatgggcagtattatctttgtctcaccttttagaaccatttccagaagtacaaaaattattaatattcccatgtggtggatcttaacttttgggagggggacatggattcctgtaggaaaggtaaaaactatggatatatgtctacgtataattttaggcagttcactgaccagcccttcctccaagccagttcatggaccaacttaatgacaccctacatacaatccgaagcattcaccaagtgttttctaacacgacatatcattagggaaggggcactatggcgtatggtgggaagatcagtacctttgatgccaagcaactgatgatcaataactttcataccagtaactttgatgcaaggcagatgtagatttgagaactggctctgcaactaagaaaggtatggcatatgcccttggaacctgtctcttcatccataagaggaggatcatgatatccatttggcagtgttcttgtgaattattagaaataatgtaaagaggcaaccacgtaagagctgcatacatcatagataataacaaagaatgcatttcagcccatagtgcagtgtggctcacagggctcgtgatgactcattttgcctgtgacatagcgactgtaaatcaacatagctcacgtaccctcagcagctatcactctggtggcagctgtgcttcacatcccacagaacaccagtgccttggggtacctaggccagggcctggcacacatttttgttttaaatactgaacagagggatattgagtccatccacaagtactggttcagtgtgtctccccacagccaaccaccagtgccagttcatattggtgagactcagcaaccaacttggtttgcaaagtgaccccatcagacaggaaggacattgccttcctaacagcaaatgagaaacgagggagccttggacttttttttttttcttttaatgtttcatagcatgacatccaggtgggtcctgacctctgtcaataccaccttcctgaggttagttccatttcctactctgcacctgattcctgcagctcccaccttcagtgagaggaggctacagttctgaaggaaaaggcttggcattgaagctatggtcttcctgggccagattcaggagggaatggaagagaacattcctttcaggacaggtggccaaaggataggagacagagtggttcagcagggggggtaggttgcacaagggtggggcaaagggcacctcctgaaagatgggaagtgggaatggggatctggcctggggctgctgtggagccagctgcagtgcaggttgcaggggagcaggggcttccgccttggggttgctgtcttggtcagcatggctcctgccttcggggatgtccaactcccacagaacatctggattctggacctcagtctcagtcttggtgacagcaggggcagggcccgtgttgatggctgcattcatgccgtagcgccgtcgcttgttaatccagtacaacaatgggctgtaggtgaatgtggcagctctcatcacctccacccactgctgggcatgctcttcccgcctcaagttcttcctccagtgcagaaagataatgcaccctccagttatcacagaacacagccccaggattccaaagtacaatgagacccacactaaggcagcaagaaagaaaaagaggcatgctggctgatagctgtagcttggggcctgagctgtttctcattcctctttcacttaacccatgcatcaatcactccatccacttaactactctcaccgttccttccctcccttattgacttgcctcatcattcccttattcagtcaaagctagatttccagggagcttaagcaccacctttaactctttacagatcacaaaagctaggtctagcgggggcatgtgctgcccaggctcagtcaagcctctgattcctaacccaggacccatccaatccatcagactgagaagtttcactatgggcaagtccatcaagaagcaaaagttcaccagcactttgtgaggcccaggtgggcagatcacttgaggtcaggacttcaagtccagcctggccaacatggtgaaaccccgtctctactaaaaattttaaaattagccaggtgtggtggtgcatgcctgcagtcccagctacttcagaggctgaggcaggagaatcacttgaatccaggaggtggaggttacagtgagcctagattgagccactgcactccagccggggcaacagagcaaaacttcatctcaaaaaaaaaaaaaaaagtgaaagttcatcagttgacagagacaccaatgtcccatcccattccattcagctgtgatagtcctgggctattgatagtatcttctctggttgatcagagcatggtctttgccttaaaataattcttagttttctagagtagactatctcctaactgcttagctctcctccaggcagccaggcactgtcccatccatgcaaagggccttccctgagtgtttgtccccaagccctaaggcacaagtccagtgacagggactggaggagcacttactcccagggaagcgcaggtcctcctgttgggaatccatacagctgagctttggtacctggccgatggctctggggagagggaactcacccacccatctgcccagccagtcagcccatctgcccagccaatcagagtctccagaatgcccaggccctttgttctctaaaggagaggtcactgggttctgagaattgggcattctaggggcagtgcttgtgaagtggtcctgggttaatggaaggaggggacttcatccagtggcattttttgggtggaatgtcactactacttccatcagagactggttcacctattgaattgtctgtacctaccccttatggtgaacccacagagcagaccccagaaaagggccattgtccctcaggtacttacggatgttgctggtctttagggaacggttgatgggatacctgtccccagtgaggaatgtaacaaggaacacacagcattgggcagccctgttctcaaaaagtatctaaccaagttggcaggaagaaacctgctcaagggaaccaagtggtcaatacctccttctttggctccaacaatctgtcttttatttaattaccttccttcaagtgctgacaagtgtttcccaggccccaggccctgtggggcttcccaccatctggcctgcatctacttccagccttacttccctcctcgtcctccacacacttttcccttttgcctagtccgtactcctgaacagaccctgctcattcacatctctggaggtgtgcccatgctgctccttcacccaggagtgcccctgcccacttttccaccactgaacacctgctcatccttcaagactcagctcagcccccctactctgtgacagactgcccagaatcatatcatcgccaatttgaagaaactttgagagttgtctagttcatctccaccatctgatcccaccatcagggccatgcttgactcctgggggtagatttttccccacacagcaactaatctccctggactcaagactcacttgagtcaggaacttgctcaccacctcctgaggcagcttgatgcatttatgggcagctcagttagaaagcccttccctaattaagcttaagtcagccttcccagtatgttgcaccactgcttgtagctcagcttcttagcaccattttaatgactcccctctttatagtcctccaatgtgtgacttagggaactatttagcacagaattctctccagggtccacttacccttgttctcctcgtatatcactggcccctactttccagtctcctttgctggtttctcccttttcccctgatctctaaatgtaggcatgtctagggctcagttcttagtgctctatctacattcattccatcagttatctcacccagacccctggctttaaatatcactatacactgacagtacgcaactgtatctctccagcctggaatgctcctcagaactttagactcatacccaaatacctggttgacatccctccttgccagtctgttaaattatcccaaaccaacatgtccaaaaccaaactctgattatccatcctccaaagtctaccctacctacagccttcctcctcttcataagtagtatctctgtccttcgggttgttcaggccaaaaacctgcaagtcatccttgactcctttcattctatcacacccacactgactccatcagcaagatctttaggcttttatttcaaaatataaccaaaatctggccacttttttttatcactatcactttagtccaagtaccaccatctctcacttggattactgttccctgtagggtgaccaacatcctggtttgcccaggacttggggtgggttctcaggacatggggctttcaatgctagagccaagaaagtcctaggcaaactggaataaattagtcacccttgggagagtttccatccttgcctccacatatcctaaatcccaccagcagccagcatgatccttttaaaaagtagatcatgttactccactgcttaaaacatatagtaacttccgatctcattcgatttaaaatcaaagtccttaaccaaggcctaagcaatctaactagccctccctataccttcttggtctcatttctgctgctgtgccctcactcattcagactcaataacctcctcatcagggcctttgcacttgctgtttcccctacctggaaggctcttcccccagcattcccacattaccttcaggtctctgctcaagtgtccccttatctctatctctcttggcctgctgtttttctgcataccatgtagcatcacctaacattatatatttactgtctgtttcactccactagaatgtaagctcaatgaattaatataaacaaggatctaagaacttcagataatgataactgctataaagagaatgcaatagagtgatgggataaagactataaagagatggaggggttgtcatttaggtcccttggaggtgcttacatgtgaactgagcccttagatgatgaggaggcagccacatgcagatccacagagaaaacagcaagtgttaggagtgtgagccaggtatgggctggcatacttgaaggacttattcatcttccattacactgttcctcgcacagggcagggctcagggctgatctccatgagcataggttggattgagcagagttgaaggctctgcccctgtcccaggaggggcttcaatcagacaaaacccagacaagaaggacctgatgatgagtactgtcccagagagcccactccaggactggccctgttctgtgagcaggtggga

SEQ ID NO: 12471 - DNA, 47742 bp, Homo sapiens
agtctgccttaaggactgcaatatttggcctgaagaagcaaaggctgcagggttcaggctttttgcatccagaggatgggaggggtgaggtgaggcaggagtgagccctgcccctgtgtctacccgagatgctccacttaggcctgttttattttttgagagtcaatataaaagcgtgtttgccataaatgtcccaccaccttaaaaaaaaaaaaaagcttaaaatccgttgctaaagaggggtcatacacaagctaaaactttttcacacacagaaaaaaataactctacatgtttgctagattctggatacctccccccctccccgcaacacagaatctggtgaccttccccctcagtcattatgtaaatgactatacataaagcttttgttatttacaaatataatgagaggatttgttcatttccaaaaggaaagggagaaacacatatcctgtgatagagctgggctttcttacctcaaaactgcagccaaatgggcagtattatctttgtctcaccttttagaaccatttccagaagtacaaaaattattaatattcccatgtggtggatcttaacttttgggagggggacatggattcctgtaggaaaggtaaaaactatggatatatgtctacgtataattttaggcagttcactgaccagcccttcctccaagccagttcatggaccaacttaatgacaccctacatacaatccgaagcattcaccaagtgttttctaacacgacatatcattagggaaggggcactatggcgtatggtgggaagatcagtacctttgatgccaagcaactgatgatcaataactttcataccagtaactttgatgcaaggcagatgtagatttgagaactggctctgcaactaagaaaggtatggcatatgcccttggaacctgtctcttcatccataagaggaggatcatgatatccatttggcagtgttcttgtgaattattagaaataatgtaaagaggcaaccacgtaagagctgcatacatcatagataataacaaagaatgcatttcagcccatagtgcagtgtggctcacagggctcgtgatgactcattttgcctgtgacatagcgactgtaaatcaacatagctcacgtaccctcagcagctatcactctggtggcagctgtgcttcacatcccacagaacaccagtgccttggggtacctaggccagggcctggcacacatttttgttttaaatactgaacagagggatattgagtccatccacaagtactggttcagtgtgtctccccacagccaaccaccagtgccagttcatattggtgagactcagcaaccaacttggtttgcaaagtgaccccatcagacaggaaggacattgccttcctaacagcaaatgagaaacgagggagccttggacttttttttttttcttttaatgtttcatagcatgacatccaggtgggtcctgacctctgtcaataccaccttcctgaggttagttccatttcctactctgcacctgattcctgcagctcccaccttcagtgagaggaggctacagttctgaaggaaaaggcttggcattgaagctatggtcttcctgggccagattcaggagggaatggaagagaacattcctttcaggacaggtggccaaaggataggagacagagtggttcagcagggggggtaggttgcacaagggtggggcaaagggcacctcctgaaagatgggaagtgggaatggggatctggcctggggctgctgtggagccagctgcagtgcaggttgcaggggagcaggggcttccgccttggggttgctgtcttggtcagcatggctcctgccttcggggatgtccaactcccacagaacatctggattctggacctcagtctcagtcttggtgacagcaggggcagggcccgtgttgatggctgcattcatgccgtagcgccgtcgcttgttaatccagtacaacaatgggctgtaggtgaatgtggcagctctcatcacctccacccactgctgggcatgctcttcccgcctcaagttcttcctccagtgcagaaagataatgcaccctccagttatcacagaacacagccccaggattccaaagtacaatgagacccacactaaggcagcaagaaagaaaaagaggcatgctggctgatagctgtagcttggggcctgagctgtttctcattcctctttcacttaacccatgcatcaatcactccatccacttaactactctcaccgttccttccctcccttattgacttgcctcatcattcccttattcagtcaaagctagatttccagggagcttaagcaccacctttaactctttacagatcacaaaagctaggtctagcgggggcatgtgctgcccaggctcagtcaagcctctgattcctaacccaggacccatccaatccatcagactgagaagtttcactatgggcaagtccatcaagaagcaaaagttcaccagcactttgtgaggcccaggtgggcagatcacttgaggtcaggacttcaagtccagcctggccaacatggtgaaaccccgtctctactaaaaattttaaaattagccaggtgtggtggtgcatgcctgcagtcccagctacttcagaggctgaggcaggagaatcacttgaatccaggaggtggaggttacagtgagcctagattgagccactgcactccagccggggcaacagagcaaaacttcatctcaaaaaaaaaaaaaaaagtgaaagttcatcagttgacagagacaccaatgtcccatcccattccattcagctgtgatagtcctgggctattgatagtatcttctctggttgatcagagcatggtctttgccttaaaataattcttagttttctagagtagactatctcctaactgcttagctctcctccaggcagccaggcactgtcccatccatgcaaagggccttccctgagtgtttgtccccaagccctaaggcacaagtccagtgacagggactggaggagcacttactcccagggaagcgcaggtcctcctgttgggaatccatacagctgagctttggtacctggccgatggctctggggagagggaactcacccacccatctgcccagccagtcagcccatctgcccagccaatcagagtctccagaatgcccaggccctttgttctctaaaggagaggtcactgggttctgagaattgggcattctaggggcagtgcttgtgaagtggtcctgggttaatggaaggaggggacttcatccagtggcattttttgggtggaatgtcactactacttccatcagagactggttcacctattgaattgtctgtacctaccccttatggtgaacccacagagcagaccccagaaaagggccattgtccctcaggtacttacggatgttgctggtctttagggaacggttgatgggatacctgtccccagtgaggaatgtaacaaggaacacacagcattgggcagccctgttctcaaaaagtatctaaccaagttggcaggaagaaacctgctcaagggaaccaagtggtcaatacctccttctttggctccaacaatctgtcttttatttaattaccttccttcaagtgctgacaagtgtttcccaggccccaggccctgtggggcttcccaccatctggcctgcatctacttccagccttacttccctcctcgtcctccacacacttttcccttttgcctagtccgtactcctgaacagaccctgctcattcacatctctggaggtgtgcccatgctgctccttcacccaggagtgcccctgcccacttttccaccactgaacacctgctcatccttcaagactcagctcagcccccctactctgtgacagactgcccagaatcatatcatcgccaatttgaagaaactttgagagttgtctagttcatctccaccatctgatcccaccatcagggccatgcttgactcctgggggtagatttttccccacacagcaactaatctccctggactcaagactcacttgagtcaggaacttgctcaccacctcctgaggcagcttgatgcatttatgggcagctcagttagaaagcccttccctaattaagcttaagtcagccttcccagtatgttgcaccactgcttgtagctcagcttcttagcaccattttaatgactcccctctttatagtcctccaatgtgtgacttagggaactatttagcacagaattctctccagggtccacttacccttgttctcctcgtatatcactggcccctactttccagtctcctttgctggtttctcccttttcccctgatctctaaatgtaggcatgtctagggctcagttcttagtgctctatctacattcattccatcagttatctcacccagacccctggctttaaatatcactatacactgacagtacgcaactgtatctctccagcctggaatgctcctcagaactttagactcatacccaaatacctggttgacatccctccttgccagtctgttaaattatcccaaaccaacatgtccaaaaccaaactctgattatccatcctccaaagtctaccctacctacagccttcctcctcttcataagtagtatctctgtccttcgggttgttcaggccaaaaacctgcaagtcatccttgactcctttcattctatcacacccacactgactccatcagcaagatctttaggcttttatttcaaaatataaccaaaatctggccacttttttttatcactatcactttagtccaagtaccaccatctctcacttggattactgttccctgtagggtgaccaacatcctggtttgcccaggacttggggtgggttctcaggacatggggctttcaatgctagagccaagaaagtcctaggcaaactggaataaattagtcacccttgggagagtttccatccttgcctccacatatcctaaatcccaccagcagccagcatgatccttttaaaaagtagatcatgttactccactgcttaaaacatatagtaacttccgatctcattcgatttaaaatcaaagtccttaaccaaggcctaagcaatctaactagccctccctataccttcttggtctcatttctgctgctgtgccctcactcattcagactcaataacctcctcatcagggcctttgcacttgctgtttcccctacctggaaggctcttcccccagcattcccacattaccttcaggtctctgctcaagtgtccccttatctctatctctcttggcctgctgtttttctgcataccatgtagcatcacctaacattatatatttactgtctgtttcactccactagaatgtaagctcaatgaattaatataaacaaggatctaagaacttcagataatgataactgctataaagagaatgcaatagagtgatgggataaagactataaagagatggaggggttgtcatttaggtcccttggaggtgcttacatgtgaactgagcccttagatgatgaggaggcagccacatgcagatccacagagaaaacagcaagtgttaggagtgtgagccaggtatgggctggcatacttgaaggacttattcatcttccattacactgttcctcgcacagggcagggctcagggctgatctccatgagcataggttggattgagcagagttgaaggctctgcccctgtcccaggaggggcttcaatcagacaaaacccagacaagaaggacctgatgatgagtactgtcccagagagcccactccaggactggccctgttctgtgagcaggtgggacacagagatgttaatgtcactgtccctgaccctaggagctcacacctggttcagacggtaaggaagattgtggcatttgggttgagagaatggaaggagagaggattccaggggtcaaaaagggcctgaataaggactcttcaaggagtaatcctggtgtttctttgggagagaataggtcactgtggctggagttcaaggaggatgtcaggaagcagaggaaaaggaggcttgggaggcagctgccatcttgaaaagagctcagctgtcgggtagaacttgaacaagtcacataattactctcggcctcagtttccttatttgttagatgaggataatactgccacacagagtatgaagccgctcagtgtcctgcacatagcaacctcagtaaagagaagcttgctgctgtgattatagttgatgaaaagaccttcgatgctgaaggacggactactacatcgagtgcctggcactacagcgagtgccaggggcaagcaccgcgaggacatggagatccgctggctttagagaacggacttggcgcgcagaggctgctggtcccagagggaggaagggcgttgaatttgggcagcctccctggaggaggcgggccgtggcatacacagggcggcgagagcgcgcagtgccggggccagagcggcgcgccccctcctccccgccccgcctcgccgctatcccgcgcccggaaccttgggcgcgcggaacctcggtgccggagcgcgggcgcggcgcactcggagcgggatggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacggcagcggggtcggggccgaggccgagctccaggccaaccctttctacgaccgctaccgcgacaagatccagctgctgcgcaggtgcgggcctgggttggctggaggcgggcaggaggcgggaggaggggcggcccgggctgctgggccttaggacagccctgtgaggtgggcactagtactgtcccagctcttcagatgatgtagccaggctccgcgaggctaggtcacttgcccaagatcacacagctaattggtgtcagagctgggagtctctgcaaagccctggctcgttccacgtttgtctgctttggttctccaaacgctaaggtggactcttatgacagccctgaggcaggcagctcagagacacctgtcctcattayagaaatgggaaaacgccttctagagaagggacttgacttgctcaaggtcacatattaagatagctgaggcctggctcagagctggagttcccaggctggtggtagcttagggccttgactgcaaggaaaggcgactggggatgggaggagggcatcaaagactaatagtgtcacagtcggatcacccattgaaccctcttaaggagactgaggatcagcgagagtaagagacttgccaaaggtcacacagctgtttgggatttgtctgactctgagtccagggtccctaacaccacctcttagcttccagagggaaggatctggagcttagaggggcttaaggtgcatatgaggggctataggagcrtctgaagagttcaagtgggaagagctaaaggagatcagaggtgaaaattaaaggggcttgggagagaatttagcagggtaagaaggtagttgtcttatgaaaggaaaccaaagacttagtactgtaaatttgagttctgtctcatctctacttccactgccttaatctactccatcatcgtcacctgggctgttgccattatcctctaactagagttccctacttccattcctggactactttaccccagttcctctcactgctactgtagtgatctttcttgccatttgaaacagttatgcagtaaatgaatgagtatttttgctctccttccagcagcattgagatagtctcaagtatttgtcatcttaaaagcctttctttgatgtacattcccctccaggcttctctcgttgatctgtatttgatctgttttacacacaagcatctctgaagagttgtctacttgtactttgaatactttatcagcatccatttattcttacccactcatgaacaaataaataactggttttaccgtccttccccactggatcattcccatcaacatttacacatactgttatccccccactgacctctaaataacatccaaactccttaatgtttcacacaagttcctcataccctagtccctgccagtctctctctagttttatctgttagcaaacttcctttgaaaaagaatggagaggaggggatgttccaggtaaggggagcagcarcataaacaaaggtacagaggcatgaaaccaccttaaccatttggggatgtttgagcaaattttcatcatartacctgttgtactttcatttgtttacttttatgcctgtctctcccactggatagtgagctccttgaggtagggagtctgacttatttatttctatatcctcagatcccagcaacagcttyactgcccaggctgtcccttgccctctctaccccttcactatggcaggcccagttgcagctgtagccactagcagggttgaccctggtcctggtacagcccccaggkctgcttgcagctctggccaggcaggtgccatgccygactaagcagaaacccctggtgaggctctttattgaggaggagccggcccactacagagagaagaaaaacatyccatctacatgacagtgaagggagtggtgttttatgtcacctccagaaaggaattttatggaagaaggggccccctataatgcattgaccaggaaagtccaccagagggatagccaagatgtccctgggtcctccagacctcacccatgaaactctgggtctcatggccaaagagctggaatccctggatgatatcttcaccaaagtgtacaaaaccaaatatcccatggttagctacacagtctgaagaattcttaatagggacagcaccccagcctggacttcaaacctgaagaccaaccccattttgacataaacaatgtgttctgttgtttcatctccaagagcagcttctttggagggtaggttagggagatactcagatgctaaatcttctgcaaaataggctacctaaagcctctgaatcaccaggatctgaataaagcagatgtttaacctggttggggggacatattttcaagaactggatgtattcaagtaaaagcttgacacctagtaaggaggctataggattcttgtctgaagaggtgatccagcaagatgacctcaaaattctaagtaccctgaawgtaagtacctgagagactaagccctgtgtaaacctagggaacagcctgcaaaagaaaaatgttacacaggycccttgaggattaacaacagttgaataacaggatttctttttccagtttctttatttctaggcctgtgcccagttcttactaactgaaggcaaatttttcaacctctctgaatggcagtgtcctttctctgtagaggtggaaagtgatgctttgttattttagaattcaaaaaggcccagttggtttaccctttggtttacctctgatcaggtcagacccagctgcttttgagtcccgcctggagaaacgcagtgaatttcggaagcagccagtggggcattccaggcaaggtgattttatcaaatgtgtggaacagaaggtaagaccttcccccatttgtggtgtttgcttaccagcactccttcaccctcctyaccctcacccttatccttaaagttggtttattgatgggtcagctgggtgaactgaacatagtctctcccaactccatttccatccataaatgtttatcctgctctttctaggcaaagtactgtggtcatggtggagatatagaagtatgagaggggtacttcctgctcccaagaggagcagtctggtggtcaaggcaaggcacacatggtagtaggctagaggtatcagagaaaatttcccatgrgagatggaacctgacctaggctaggaacgttgtrggggatttaaattaagtagagaggaaggaatgggactttgatgtagagcaggggtcatcaaattttttctgtaaagaactagatgttaaatattttaggcattgtgggccgtatggtcttctttgtgactactcagctctgccatyatagtgcaaaagcaggcctagaccgtacgtaaatgaataggtatggttctgtcccagtaaaacttaatctacaaaaatatttggcagactagatttagtttcctgacaaccagccaaccctgccaacccayccccatccattcccatgttgaggaattagcttaaacagaggaagagctttgaaagtaaaaggggtttcaggagacagcaaggtactatgcccagttaaaatggagagggaagtgttaaggctaaagaaataagttaggcattaaactctttgggcttaaggagtacaggcaggataatttagctgctaagaggatgggctctggggccakatgccaaggactgaatcctaacccttccacttactagctgggtgactctgagcaaattgttacttctccatgcctcagtttgcttatctgtaaaacaggaataataacagtacctacttcacagagttgtgctgaagagataataccatttaaaactctttagcgccgtctctggcataagtacttaatatatattagccattattatccttaaataggaatcaaagctgaggaaaagcatgttgaaaactgtgtctgggaagattattctaatgcagtgtttttcaaactttttgaccatgaccacaataagaaatatattttacattgcaattcagtacacatgtaggtatatgattgtaactgaaaaaaaaatgtataaaataatgctaacttttacaacatgcagtccattcttaytactttttattctctttcatcttttaaaaaactctgatcacaatccactaaatgtatttcacaacctattatttgaaaaattctaacctaggatggtgcacagaacaaactggtgtaggagaggccagcgccagggagaatatggagtaatccaggtgtgggctgcagaagcctgaattaaggtagttacagtagaaaattgggattctacattgtgttttaaagtcaaattagaggtgtttattttacttggaaaatactttttttgccttgggtatcctgaattttaagtgaatctgctgagtcttaatgactactactcatctgacaaagggctaatatccagaatctacagtgaactcaaacaaatttacaagaaaaaaaaaaccccatcaaaaagtggacaaaggatacgaacagacacttctcaaaagaagacatttatgcagccaaaagacacatgaaaaaatgctcatcatcactggccattggagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaacattgtggaagtcagtgtrgcgattccttagggatctagaactagaaataccatttgacccagccatcccattactgggtatatacccaaaggattacaaatcatgctgctataaagacacatgcacatgtatgtttattgcggcactattcacaatagcaaagacttggaaccaacccaaatgtccaacaatgatagactgaatcaagaaaatgtggcacatatacaccatggaatactatgcagccataaaaaatgatgagttcatgtcctttgtagggacatggatgaagctggaaaccatcgttctcagcaaactatcgcaaggacaaaaaaccaaacactgcatgttctcactcatrggtgggaatcgaacaatgagaacacatggacacaggaaggggaacatcacacactggggcctgttgtggggtcgggggagtggggagggatagcattaggagatatacctaatgttaaatgacgagttaatgggtgcagcacaccaacatggtacatgtatagatatgtaacaaacctgcacgttgtgtacatgtaccctaaaacttaaagtwtaataaaaatagaaaaaaataaaataaaatgactaattgagttaattagaacaggattaatagtaaatgggttgccaggcgcagtggctcacgcctataatcccagcactttgggaggttgaggtgggcagatcacttaaggtcaggagtttgagaccagcctggccaacagggtgaaaccctgtatctactaaaaatacaaaacttagctgggtgtggtagcaggcgcctgtaatcccagctacttgggaggctgaggcaggagaatcgcttgaacctgggaggcggaggttacagtgagctgaggtcatggcactgcattccagcctgggcaaaaaaaaaaaaaataacagatgggttaattataataaggttggggagcaaattcaactcctatgacaaatagagtttacaactttatgtgagcaaacaattctttactacaaatattttaacaattgtcatttcctataataaacacttatagtagtaaggttacaagtcaatagctcttggaaatattactatattataaactttaaatattagataggaatgttctttgcccctttttggtaaacagacttagaaatttggctttatgaggccgggcgtggtggctcacgcctgtaatgccagcactttgggaggccaaggcgggcagatcacgaggtcaggagattgagaccatcctggctaacacggtgaaaccccttctctactaaaaatacaaaaaattagccgggcgttgtggcaggcgcctgtagtcccagctactcgggaggctgaggcaggagaatggcgtggagccaggaggcggagcctgcagtgagcggagatcacaccactgcactccagcctggacgacagagtgagactccatcttaaaaaaaaaaaaaaaraaagaaatttagctttatgataaaatgtagaatatgtaaagatttaatttaaattgtggcagctcttaggtaaatattcacttgctatcttctgtatctagctagatagaggaaggctaacggctaacacatattttccattcccacagtcttgtctttactactttgagttattggttccccaccayatgggactcaacatcccccttttataatacattttttaaaaattctcccttttctaccctgaaataaaacaataggtatgtaaaaatataacctacctgtatgtataacctcaggtgggaaaatcaatataatgccctamccataatataaagaaaagtattttttaacaaaatacatattttagcatgtraatattagggcacgactayactgtgagacctaatgtagtcatgaggtgcttccacccatttctgaaataaccttgaacatgtaagcagcaaatactgactggcaaatgggtgttatgttgataattataaaaactctaaaaccaccgggtgcagtggctcacacatgtaatcctagtactttgggaggccaaggtggcagatcacttgaggtcaggagttcgagaccagcctgggcaacacggtgaaaccccgtctctactaaaatgcaaaagaaaaattagccaggcatggtggcgcatgcctgtaatcccagctactcaggaggctgaggcaggagaattgcttgaacccgggaggcggaggttgcagtgagcggagattgtgccactgcactccagcgtgggcgacagagtgagactctgtctccaaaaaaaaaaaaacctccaaaaccatgagcagtgttgttatcagtgacctatgattccacaatgtggaatctttcaagttatatagtagttgcatttctggaaattttagtattaaagcagtgtttaaaaaaaaaaggttctaggcccaagtaattataaatattgaaatattataggtattttcagctgcaagaatgtctagctagacattgaaaagttgtacaggatgagggaaattttttttattatgtagaactcacccatttgacacccctcccataatgtagatatcaatatccaataaactattatgataaccataaaattatctgcacagatttccaaagcatccatagtagggaagtaaaryacccatttaaagttcttattaaatgcttctgatttttgacatgtagtttcaactgctttaattaccttatttcatcaaatctaaagctcactcttatttttctcattttaacatcactaaaattgtcttataattgatatgacaggaaaatattgtgctatttaattggcatcattttctgatgcataaaataatggtgcatcttaagatatgatgtcttagatttgataaaatgcaatacgcttatacttagggcttaaattttttatttctataagtgaaaatggatacaaataatagattggagagacattgtgtaaaaaccgatacatgaggcttcatgactgaaaggtgaaagcagctgtgcaagtggaggttttgttttgtttttgtttcgttttcatggtacacctgagaatgagtgktatgaaaatgaaattctcatcaggcacagtggctcatgcctgtaatcccaacactttgggaggccgaagcgggcagatcacttgaggccagaagtcaagaccagcctggccaacatggtgaaaccccatctctactaaaaatacaaaaaattagccaggcatggtggcacaagcctgtagacccagctactcgggagactgaggtgggagaatcacttgaacctgggaggcagaggttgcagtgagccgacattgtgccactgcactccagcctaggcaacagagctagaccctgtctcaaaaaaaaaaaaaaagaaagaaagaaaatgaaattaactcctttttagatggtttacatatgaaggaacggctacactgggatgttgtcagtgtataggtgcgtgaccaaaaagactaaagggtgttcaacaggcttttctctaatttgtgggtacaggttctatgaccatcatttatgaaaagtgtggattaattaaagcacaaagtgactaaaggcaaggttttatgcagaaagtgtttttcagcctcagaatcccaggtgtcgaatgtacttctgagaagcacagccttgagtggaagactcagaacaacccatccctactaccagaaactactcaaaacaggatttactagctatgacctttatgagagataatggctacgagacaaaataatcactttcagttgttggtggcctttttttaagggtgtctaatttgatagaggaaacattaagattgaacactcaaaatgactctartctgctgaggatgcctaccatcaaagtgttgtcagagataagcagtatccttggataacacatctttccatttcttacctctcccatggctcagtgtggaataggtcaggacagagcacagtaatcccaagcaggcctaattctgggaagaaatccctcatatccacagtggcaggtggagaatggactctcagtactagtagatgatagtttactgagagagaaatcttatctctgaatctcagaatcttagaagaaagttgttttcttataaacaataatttttatttttatttctttwtatttatttattttattttatgagacagagtctcactctgttgcccgggctagagtgcagtggcgtgatctcggctcactgcatcctccgcctccygggttcaagcggttctcctgcctcagcctcccaagtatctgggatcacaggcacccgccactatgcccagctaattttttgtatttttagtagagacggggtttcaccatgttggccaggctggtctcgaactcctgaccttatgattctctcgcctcggcttcccaaagtgctgggattacaggtgtgagccactgcgcccagccaacaataatttttaaaatagtgttaaawttttagaacaattattataaaaagtggagagaagtgagttctcacatgcaaaattatttaatgagattgggtacytcacctagcttagttaccttttttcttatgagtaaagtgtagattaatatcttgtcttatatatttcagacagatgccttggggaaacagtctgtgaacagaggattcactaaggacaaggtaggtttctaattaaatataggaaaaaaagcttgaagtcatatrggacatctagaacaagaggctgcaaatttgaacataagtactgtggctcagtgattttgtgtaaggtgattttccagctgtagaagtgagaaatatttctatgaactttgtgtccttgaccatgacccctagcatagcagtttaattaaaaataacaaccaaactttctcctcttaccagctgcaaagtgccgcaggactcattggtaagggtgaagcctttgggaagtacatggcaacctaagagagactcctcaggaacagaactatgaaaacctgtctaggcttgggggctcactttctctgagcatgtgggttttcttatacttgttttctacttttggaaatctgtttcattgtcctgacatgtttgccacaggcttagagatagagttaagctgtttttttttttttttaattatgtgttaattgctttttattgtctctttcaagactctcagttcaatctttaacattgagatggtaaaagaaaaaactgcagaagaaataaaacaggtaatgaatggaaatgggctggcctactctatgaaaatgtgaattctgtgaaccaaatctgaaagtacattttctgacacctctttctagccacaatgaaaggtaataataaaaggcaaaagtgatgaattacttgaagaacaatgtcataagaaaacttgtcttctttgtcactcttatatgtctaatcaacttgtatktctagtttctttttcattcccataatccacatctcstgtaaccctcatcagtactctgtacctggattactgcactacctttccaaataggtttcccttctccttttttttccactccacccataatattctcatcaactgagtcctctgaaacttctcctttcattatggagaagtatagtgtattggtttaaaaacacagactctagaaccaagctgccggttttaagtcctagctctgccactatctataggacttggacaagttaatcaacttgtctgggctttagtttccctatttaaagtggagcaaataatagyacttacctcatagagttatttggataattaaatgagttaacatttattatcacttagaacagtccctggcatagagtaagtgctatatttatgttttttaaaaaatgggaaaaaaatgtattaggaacctggtcacaaatgttcagtgacttcctgtattccttttctgggcattcatagctctccattatcacaggaccttcttcaggaagcttcytgaacactttccttcaaagcactcatgagctatcctgcctgtttggtcatttatatttttatacctgtgattcttttctctctaataagctatttttctggcattctttatagttccatgaattatayattaggtagattgagaggatcaaaataataataaaagcagcatactctgtatcaggtacaatgcctaatgcttcatrtgcattatttcattaaattctcttaaccaccccgtgaagtgggtgccattattcccagtttacagttgaggaaactgtgacttaaagagattatgtaacttagtcagtggtagagctgggactcaaacccatgtctatttgactctgcatcatattcccacaactggaagttgtgccagttgccatgggtttcctttgtatgctgtatcatttattttagcacacatttaatgcataccaattaaatgtcagactctgtkccagatacagagataaatgagagaatcctcatccccaaggagttttagcctccgcaaaacggatcagatcagcacagggttctttctattaatagaggcatatgcaaagtgtcagggagaactctggctgtgcctttgggaagaagtaccaaaggaacatggacacaaaacatgtcatttaggggaaaaagaagccaggcccaggaggcctgatcatatgacaagtatcattgagacctatagttttaggtataaatttgtgtttgttgaaatgagtagctaaattcaactatataaggaaacatatatcagtctcatgaatttcagttttgattcataaactgtctgctaatatcataaattaaataaaaataatcagaatatgctgtccttaaaatgagaagacaatgttttgacatgcaaaaaaagaaaaggtaaagcaaccttatgccacattgagagtagtttccataggtcctaggagttaatagtccttttgtgctctgtgttgattagatggatcacactttgattagtatcttcaattggggccccatattttaacagaaatgttgacaaaacagaccaactctaaaggaagttgacccattcttcaacactagctcactctggtgtcaccttggttatgataccctcctctacttctatgcctttgttagtgttgtcattctctgcttcaaatgtgtctcttatctccttctcctgccctacctgttatcttcccagcctccttatttccctactctaactcctaatcattcttcaggatacagttccaagtgtcccttcctctggcactcttccctaccctgggttaagtgcctcttttagattacatgtttyttattatttcacaatcatctatcattcaaccagcatttctgagtactttttgggttgcaaggcattggtgacaacacagcagatacctgcctacagggggcttgcaaactagtgagggaaatagatccatatgcaaatgatcttattatgaagtagcatatcctaggcatcttaagagagatataaaatatgaaagcaagggggaggaaataaataaaatagaaaagcarctcataggaaaacttctgactgtaatatcaagggaaactgcatggaagaagaagcatataggctcagcttcagagtacaggargaatttgggaggtcagaggtaggagagagaggctttctagtcagagccaataacatgtaaaaaggcatgggaaggcaaaaaaaaggtagtaaaaaataagaacacagagcatccatatgatattaatggtaaataatgaaaagacacaatattgcatatatgctacatctatgtatactataaaagacatgctagaaagaaataaagtaacagtggtctttgttagggtggtaggactatgggcattttttccttttccctgttttctaattttcaaattttattatataatttttttattccccaccttttggtatttgcatcatgaaggtcaactgtagcttccttgttcgttagtgtcaagcagaggtaggacttctgattggtatataccatagtcagatccaacagaccttatctcttccacatgtagaagactttctggaagcaggattttaagagctgcctataacatgccaataatatctaatatggttttgctgtgtccccacccaaatctcatcttgaattgtagttcccataatccccacacatcatgggagggacacaatgggaggtaattgaatcataggggcagttacctccatgctgttcccatgataatgagttctcacgagatctgatggttttatagggggcttttrccccttttgctcattcttcttcctgtcaccatgtgaagaaggatgtgtttgcttccccttccaccatgattgtaagattcytaacgccttcccagccctgtggaactgtgagtcacttaaacctctttccattataaattacccagtctctggattaagaaaatatggcacatttacaccatggaatactatgcagccataaaaaagcatgagttcatgtcctttgcagggacatggatgaagctggaaaccatcattctcagcaaactatcacaaggacagaaaaccaaacaccrcatgttctcactcataagtgagagttgaayaatgagaacacatggacacagagtggggaacaccacacactggggcctgtcagggggtggagggctgggggagggatatcattaggagaaatacttaaagtaaatgacaagttgatgggtgcagcaaaccaacatggcacacgtatacctatgtaacctgcatgttgtacacatgtaccctagaacttaaagtayaataataataataataataataataataataaataaataaataaattgcccagtctcaggtatatctttattagcagtgtgagaatggactaatacaatatctaacaaaagctaacattatttgtagtgtttattctgtgacaagtgctgagctaagcacagacctacattatttcagctagtcatgacaattctgtgaggttattattgctattttattgatgttttttagggagttttcagtaatttgcccaaggtagtatagctagtaaatgactggagctgagattcgcatccaggtctgcctgactgtgaaccctgagctctagtcctgactctctgggaaggctcagttggctggggaggtgtgggtttggggaggaaataaaaatgtgaaaaaaaagaagttgtctatcacacacaaggcacatattaagaggaatgacttttaaagtcagagaatcagtttctctgtcaggaatttgttattaagagttacagtttaatcatctagaagagtggattgtattaaatcttttttgtgatgtgctagtaatgaaagcgttatactgggtttttcctctctgttatcaaatagcatattcctctgagcaatgaaaactgtcaccatttcttggcacatgttgaaaagattacccacatgtcacagacacccctctcttttttgtacagatttggcagcaatattttgcagcaaaagatacagtctacgcagttattcctgtaagtagtttggagggcaaagtgaaagtgttacaacatgaaagtcagttctctaaccttagcaggcagttgcctttacttttcctatgtttattgcctcttgagaagctgcattttacagccctgagagtttttattatrccctgagcaccagagattggaagctccatatggtatatttatggctcttgttttcctcctttctactttagaaatgtctctgagtcaagtctctgacaagggagcgtggtataagttcatgttgctgagtaatttccagatgtcttttttttcttactgatgttttccaaccaagctgttggaatttaagacagggcctctagcacagcttttttcccttcttgcctgtaagtgacctatacctgagctgacttggagcctcttcctagtctatctctggtgaatattccccttagcaagtggcattttcttggtctttcccttcttgaaattattcttagagatggtcaccatctactgcttgaccattaaggtctgtgacagagaagggatgctgctggcttctctggtttaatgttttgctggcctycactataataaagcatctgaagtactggattatcagctagttctttgtttttccctgaaggaggggtgggagcttaggttaagtttctatcaagcacacaaatatatattgagattacatgagtaagtgtaagattaaggaggaaaacatatagatggaaggataaagccaggccttttggtggttatgatggtatcgctatctttttttttaatctctcatatatatatacccttatcctacatgaattcaacarccagaagaagagtctgcrctttttgtgatgttttagatctctgatactgactcattgtttraacaggccttcttacctctccctcaaactgacttggtgacttgatgtctctgacaattgttaaagttccctggagcattggtgcacctagtctttacacataattctgacaataaacagcaaaacagacatctggtttttcctgtctttctgtcataagagtgatttgaaaatgatgaaacttaaatgactgttttagttgtattataattctagaattcagtcttggtgaattacatgtgatagtggccttttgtgttttactatgtgtaggttaactttattcttttccaacctacaggcagaaaagtttgatttgatctggaaccgggctcagtcctgtccaacagtaagtttctggtgatcacgtaagggttgcttatcaatgttgccaaacaagtattttccagccmatcacgtcatattccatactrtctcacatgttatagtgctctgtttacttaataaagatgctcacatgttgattgtactaataagttatagtkctctgtttacttaataaagatgctcacaygttgattgtactaataagtgacattttcagccttatgaaatcatgtgggtttgacccagtaagcctctggctttttagctccctaccacatcagccctttctgatgtagatcttaatctatcrgtacaagtgcgttttggaagacatctgagaccttaatcttttcaacttctttttttttttttttttgcttttattattatttttaattgacacataattatacatatttatggggtacagtgtgatagttcaatacatgtgtgcagtgtgtaatgatcaaatcagaataattagcacatctatcacctcaaacatttatcatttcattgtattggtaacattcagaatccattcttctagctacttgaaaatatacaataattgccattctaactggtgtgagatggtatctcattgtggttttgatttgcatttctctgatggccagtgatggtgagcattttttcttgtgttttttggctgcataaatgtcttcttttgagaagtgtctgttcatttcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatggcaatcattaaaaagtcaggaaacaacaggtgctggagaggatgtggagaaataggaacacttttacactgttggtgggackgtaaactagttcaaccattgtggaagtcagtgtggcgattcctcagggatctagaactagaaataccatttgacccagccatcccattactgggtgtatacccaaaggactataaatcatgctgctataaagacacatgcacacgtatgcttattgcagctttattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatggcaagaacaaaaaaccaaacaccgcatgttctcactcataggtgggaatcgaacaatgagaacacatggacacaggaaggagaacatcacactctggggactgttgtggggtggggggagtggggagggatagcactgggagatatacctaatgctagatgacgagttagtgggtgcagcgcactagcatggcacatgtatacatatgtaactaacctgcacattgtgcacatgtaccctaaaacttaaagtataataataataaataaataaataaaaagaaaatatacaataaattattgttaattatagtactccatagtgccgtagaacactagaacatatttctcccatctagctgtacttttgtatcccttaaccaamctttggctattcgttcctctagtaaccactctcctactctctccttctatgagatcaggtttttttttttttttagcttccaacatgtgagaacatgtggtatttgtctctctgtgcrtggcttatttcacttaacataatgttctccaagctcatccatgttgtcacaaatgacagaacttgttcttttttgtggctaaatagtattccattgtgtatagataccacattttctttatccattcatttgttgatggacacttaggttgattccatatcttcgctattgtgaatagtgctgtagcaaacatgggagtgcagatatctcttcaacatactaatttcctttcctttggatatatatccagtagtgggactgctggatcatgtggtagttctctttttagttttttgaggaamcttcataatgttttccataatggctatactaatttacgttccaccaatattatacaaaagttcctctttctccacatcttcaccagcatttttttttttttcatttagagatgaggtcttactgtgttgcccaggatgggcttcaaatcctggcctcaaatgaccctcccacctcagactcccgaagtgctgggattacaggttgtctttttttttttcgtaatagctgttcaaactgggctgagatgcctgttttattggcagttttcttcacagttttggctatgctatcctggtaatatgtgcctaaaggaattaagaggtcgtagctgaaatactgagctgccagaaggcctaagggaaaaggaataggtggggtggaccagctaacttggtatcagtaatgatttctcgggttttcaaaacatttttggaaacattgctgaaaacagagaatacctaaataaatggaaatgatatataccatgttcatggattggatggctcagtttgttacattttgttttgttttgttttttgagacaggatcttacagtgttgcccaggctggagtgcagtggtgtgatcatagcttaytgcagcctcaatctcttcagctgaagcaatacccccacctcagccttctaagtagctgggattacaaacatgcacccccatgctcagctaattttttgtatgtttagtagagacaagatctcacttacgttgcccaggctggtctcaaattccttggttcaagcaatcctcctgcctcagcctcccaaagtgctgggattacaggtgtgagccactgtgcctaggctttgttattgttaaggtatcagttctctcctaattggtctctagatgaaatacaatactaatcaaaaccccactaggcatttaagaaattgatgagctgkttttaaaattttacttggatatttaaaggactgagatagctaaaacaattttgaaaaagaacaaagcttgaggacttacatttcctgatttcaagacttattacaaagatacagtaattaaaacagtatggtattggcacaaagatagacatgtagattaayrgaacagagtagagtcctgaaatagacaaacatatatgtggttagttgtttttcaacaaaggtgtcwataaattagagaaaggataatcttttcaacaaatgctgctaaaacaattgaatatcatgcacaaaaaaaaggaacctctacttttacctcacagtgtatacaaaaattaaagtagatcataraagtaaatgtaacttttttttttttttttttttgagacggagcttgctttgtcacccagggtgcaatgtagtatgatctcagctcactgcaacctccacctcctgggtttaagctattctcctgcctcagcctcccaagtagctgggattacaggtgcctgccaccacactgggctaatttttgtatttttagcagagaccattttttttttgagtcagagtcttgtactgttgcccaggctgtagtgcagtggcatgatctctgctcactgcaatctctgcctcccaggttcaagcgattcttgagcctcagcctcgtgagtagctgaagttacatgagcccaccaccacacccagctaatttttatgtttttagtagagacagggtttcaccatgttagccagtctagtctcaaaactcctgacctcaagtgatccacttgcctcagcctcccaaagtgctaagattacaggcatgagccaccgcacctggcccataaatgtaacttgtaaaggaaaataaaagaagaaatctaaattaccttgggtttggcaaagatgtcataagtacattacaaaaagcacaaactataaaagaaaaaaatcaccttgggcaatatagtgagaccttgtctctataaaaaaaatttttcaagcacctgttgtcccagctactcaagaggctgaggtgggaggatcacttgagccctggaggtggaggttatagtgagcccagaccggacaacagagcgagaccctgtctcaaaacaataaaaatagggtgggtgtggtggctcacgcatgtaaccccagcactttgggaggccaaggtgggtggatcacttgaggtccgaagttcaagaccagcctggccaatatggcgaaaacccatctctactaaaaatacaaaaattagctaggcgtggtggtgtgtgcctgtaatctcagctactccggaagctgaggcatgagaatcgcttgaacctgggaggcagggactgcagtgagccgaggtcacaccacagcactccagactagctgacagagtgagattctgtctcaaaaaaataataataaataaattagatttcatcaaaattaaaacattctatttgcatacccaaatagcttctacattcatagcaacattagtcacaatagccaaaaggtgtatagctcaagttatatcagaaattcttataactcaataataaagaggatagacaaatggacaaaggatttgaacattttatcaaagaatagcagataagcacctgaaaatatgcttgacagcattagtcataatgggaatccaaattactacagtgagataccattagaatgactaaaatgtcaaaaactgatcataccaagtattggtaagaatgtgaagcacctggaactctcctatactgccggtcatattgcaaaatggtacaaccactttagaaaatagttcggctgtttctttaaaaattaagcatatacctgccatactaactagccattccatttctagatattttcccaagagaactcaaagaatatgtccatagaatgacttgtgcgcaaatattcaagcagctttatttgtaacaaccaatgctggaaacaatgcaaatgtctgtcactagtgcacaggaattgtggaaagagagaatgtgcatgtgtgtgtgtgtgtgtgtktatgtgtgtatacatacacaatggaataatattcagcagtaaaaggaatgaactattgatacatgcaacaacatggtgttctgtgaaagggccatatgtgcaaaacgacccccaaatggtgaaggagctgaaaaaccaaagaaggaggcagacaaatccaatttgtgggtatgggatgatttattgggggaacttacagacgggaatgtcgtattgggtggctgcaatacaggtagatctccacaccacaaccagacagacccaatatgtcttatatcttggggaaagtatacatgctctggaaggaatgtgtaggtggatacagtcatcactgcctatgatttctgcaacaacatcaaggattgttttggaagaatagatgtttctacataaagagtaatacatcaactagacatttgggaggcattcctggacttggggttagtcagaagtcacacggtggactagcatttaaaataaagtcactcttgttcctacacatggatagatcatgaaacagttatgctgactgaaagtaaccaaaccaaaaaagtactcattttgtggttccgtttttacaaaattctacaaaggcacactaacctatagtggcagaaagcaaatcagtggttgcttagggacagtaagggacagggaagtatgaacttcaaagggcaaagaaaacttggaagtgataaccatgttcattttgttgattttggttatggtttcacagtacacatatgtcacactcatcaaattgtatactttaaatatgtgcactttgttgtatttcaagtatacctcaataaagctgtaaaaaaaatattttccctagcaagggatcatctgtcaagtaggcactaagtttatctcatctaataataataaattggagcctgagtggttgacaataagaagataatttgtgactaatgtgtattgggctgctttatacttttgttttgttctggcaccattcttttctctactactcatccccattctaaacatcttgagcataaaacttattttttggtgtttagtctggagccatgctccaatatcagccttatctgatagaatgtgaagtaattacagcaattggaacgagctaattcagcagcattagaaagtttagaaattgaaacatccatcaagagaaggataaatagtgataaacttctacartagaattccatacaacagtgagatatttatgaattcagagttatagatatcaacatggataaatctcagaagcatactatgaagtaaaaaagttacaaaaggatacacacactttgataagatttaagtttttaaacatataaactactactttaaaaaaaatttttctaaagacagggtctcactatgttgcccaggctggtctcaaactcctgggctcaatcagtcctcctgcctcagcccccgagtagctaggacaacaggcacatgccaccacacctggctattttttttatttttttgtagtgacggggtctcactgtattgtccaggttggcctcaaactcctgagctcaagtgatcctccgaccttggccttccaaagtgctggaattacaggtgtgagccaccatgcccagcctgtaaactactacttcttaacttacagttatacgcatatacattaaagtattaaaatatgaaaaaggaggatagacaccaaatgctggatagatgttaactctgggatgggattagaagggaatgcagagggaacctcaattgtatttctgatgctttcttaggtggattgataagtacatgagtatttattgccacatatgaatttcttaattttaaaaaaatgttttaggctgggagcagtggctcatgcctataatcccatcactttgggaggctgagggaggcagattgcttgagcccgggagttcaagaccagcctgggcaacatggcaaaaccccatctctaccaaaaaaaaaaaaaaagtagccaggcttagtggtgcacacctgcagttccagctacttgggaggctgagtgggaagatcacctgagcccagcagatcaagactgcggtgagctgtgatcatgcctgcactgcagcctggacaacagagcgagaacctgtctcaaaaaaataaaaaaatattttaaaaaccaaatatggaggaaatggaatgaatgttacaggtggttggatatagagcaaataatttcatttattcatctgtctccttgtatatctgtttttcacagtttctatgtgctctgccaagaagggaaggttatgagttttttgtaggacaatggacaggtactgaactccacttcactgcacttataaatattcaggtaggtggcttgtgcccttcctctagaggaaagaggactaccccttggtaggactagaaacccttggctgaggctcaaggacacagaatagctgcttactcccagcatttattattgtggcrcagatgaattgtcatactttttgtgttggactagttttctaggscctcctcaatacctagaaattggaaaagactccaaaacaccttctctgactacttctggttctcttttgtctcttccccagacctctagttgtatatactgcatgtgcctcacttaacaaacatgcctgagttatgatggctatctttttaacccaagctagaagccccttgaggaaagctccaagtcttaaatgtgttttattacctaagtcaacaccttccaacatgctaagtgaatagtttctgtttaataaatgttattttgtttgctttcttcctttatttctttatttccaataaaacaatattaacttttaaatattatatttaaaagttagattcaaaacatttaaaacttttaaaataaaagtcaatattttaaatcataactaggattggcattctatatttggaggtcaaatgtggcaaaaaacaagcaygaattatattggctttgaagttggggtaaagaatgcaaaatagaatgaaggaacagctttttactttgctattttgtaatatgtctaacaaccctttattgagtacatactttaataaccaacaatttgatgtacttactatgtgccacatgttttatatatattatgtcatttaatcctcataatacgccatatttactgttattatttctaattacatagaagaaagtggcctcagatgttagttcacattgtctaataagtgatagagccaggattgagcccaggttatctgacttcaaagtctgtgaacttratcattatgggattgtgttaggaactgtgctaagacttggagatctgtgagacaaggtccctgccttcatggagctaatattcagstwtaggagaaagatccagaaacataattacaataaaagtgattagtataatattagaatgatgaccaaaatgatcagtgtaacattagaagtatgttcaagaaaaatgagatgctgaactattacaagtaccctagtgatagttggatatttataattaaaaagactcgctgaaattttagagataaagtctaggaatcttcttttgaatgtagttgtttccacctgtgctatgtaggggctttagctttgaacccatcctctctacctagtctagacttgagatttagtaaccactgccctgatcattcttcataaaatcatggtgtttccatccttcttctccccttcacccccyaccaacccagattatattttagagctgcacattacaaatctggctcatgtgcaaactctgcagctcctgctacagcttaaaagagctcagtcttcagagccagccaaggggagtagatttcaactgtgaaatgcactagtccatraaagtggcaattacacaggcacattgctttctttagaacttgatttggtagctgcttgtgccattttgtttttaaaygtatggtcacaatgatggattcactgcctactgtaaacattttctgggaaaaaagccaaaccttttccagttgaagacacaaataacactgtgcaaactgtcagtttcactgtgcctttgcaggcctgaccttaccaccacataccagtcctccaactcacyagccacccaaggggctgttaagagccagaatttcctctagactgtctattgctttgaaattgcagtttrttgtgatggtaccttattgagccttgataagtgttccaccttgcagacccgaggggaagctgcagccagccagctgattttatatcactatcctgaacttaaggaagaaaagggcatagtgctgatgactgcagaaatggattccacatttctggtaagaattaacttgcaaaactctttggatttacctcrtggcactgaaggtattactcttctgccaaagctcatgagagagaaaatttcaaagagctacatataccttgtttcttacttattttaaagttgacagtgaagttgtcttgctcaagatcttccaatttgaagttagtacagatcctcaatcatttattcacaattctgaaacccatgggctctgagaacaaaatgtttttgttctcatttggtcacaaaaccttatgtaaacttgaactcatttggtaactaaatctttaaactgatgtgaaactatttatataactaatcccacttggtgtggagtattatgcattttactagggaaatattaatgtgtttgagtatggggagtcacataatatagttatatagtatctatacctattatctttctaaaattcaataattctgaatctaagacacatcaggccctaagggtttcagataagagattgtagayaagtaaatggcttcttaattayagggaagagttgtattgaagcctaggatagctctcaatattttatcttccttcatactgttcatttatacaacattcatcatttatagtgtttttctttcctccttttcccactcctagatgagaatcactgagatagagcattgaccatatgctcatagttaatgatgcccactgtgttctctctgcacatccaggtgccaggagcagtgttgtgattactgtacactgtctgtctagtccttgctcatttcagtcacatatccttttatctggcagaggttaagttcagaatgtccccaaacagtggacacttccccctaacagtcttcattacagcacccacttattttttctctttctcttaccagctgcatagggagaaagaagtgatatcactcagctgatatctcacagtagcagtaacccacaaacctaggacacagtgaggattctacttccctattcttgaagctattcagtaccatctctcccattcttccttccacattaacccttccattcatcacattcaactgaaagccaaaattctatccaagaatatggaattgccattaactgagataggcaagattgcaggaggaataggcctaacaggaaaatcaggagctcacttttcgatgtattaaatctgagatgcctattagatatccaagtagtaggcaattagatatatgagcctggacttcatgggagaagtccaggctggagatataaatatgggagttgtcagcatacagattgtacttaaaaccataggactgaatgaagtcaccaaggaagtaagtaaaaatagagaagagacgagatctaagaactgagcgaggggtctccatccctggagagatgaagaagcatcagcaaagattaagaaggaatggccatgaggtaaaaggaaaattaagatggtagaatgccctggaagctaaaatygaatgtttcaaggaatagggactgctcaactcaccaaatctcccttgtttattagggcaaatgagattagractgagaatttactgatttcacaaacatggaagtcactgggggccttataagagcagtttcataaaagtgtgattggagtagacttaagagaggatgggaagagaaactccgaagaatcagcatagaaactctttcaaggggcatttctataaagggaaggagagaatggggtattagctggaggtggagaagtgcgcccaagggtatcttttgtttcaaatatgagaaagaaaacatatttgtatgctgatgggaaaggtccagttgaggctgggcacagtggctcatgcttgtaatcccagcattttgggaggacaaggtgggtggattgcttgagctcaggagtttgagaccagcctggccaatgtgrtgaaaccctgtgtctacaaaaaaatacaaaaattagccaggcgtggtggcatgcaccttgtaatctcagctgctcggaaggctgaggtaggaggatcacttaagccccagcagcaaaggttgcagtgagctgagattgcaccattgcactccagcctgagcgacagacccagactctgtctaaaaaaataataataataaaataaaataaataaagatccagtggagagggaaatgttgatgatacaggagaaagcgggaagtgatatttttgagtgggcaagtctggtaatgaggggttgatctttaccaggaatatgacagcaggagagaagccagagtataaggacactgataaaattagatggatagaggtagtggtataagtttcctacagattgctcagtgaaaagaaagaaaagttctcatcagctgaaagcaaggttggaaaaatgttggacatttgagtcaaaaagaggaagtacaaaattgttgtctaggacaagcgtcagcaaactacagcctatgggccaagtccagcccactgcttgttataacgcccacgagttaagaatgttttctacctctttaaatgattagggggaaaaactctttttttgtttgtttgtttgtttgtttgtttgtttttgagacagagtctcgctgtgttggccaggctggagtgcagtggcacaatctcagctcactgcaacatccacctcccaggctcaagcagttctcctgcctcagcctcaagcagttctcctgcctcagcctcctgagtagctgagattacaggcatgtgccaccacacctggctaatttttgtatttttagtagagacgaggtttcaccatgttggccaggctggtctcgaactcctgacctcaggtaatcgacccacctcggccttccagagtgctgggattacaggcatgagccaccacgctgggccaaaaactctttattcttaaagaaatacagaaattatttaataacaaaaartattattaaagaaaaatagtatttcaagttttattagaacacagccatattcatttatttacatattatctatggcctgaaggaagttaaaggtgaatgcaaaggaatgattattgaccatggaatggaagctgggtaatgaggaaagtgaaaatataagggaggttagagacagtaagaattatgagtcctaatgggttgtgggagttggaagtgagctgaaaagataggaaataatttgatcatgcaagtgagtgacaatatagagattgtactatattttctggtcttcggcaaagcacagcatctaatcatattaaaagtggatcctayaggtcagaggaggcccattctgctgtttgccatttttaccacctcactctggtggtctcaaactgctgtgcagttctcatcattgttaaaatttgcttcctggccttttaacatttgacagcatacaagacaatacatatttgccttgtataaatcaacttgactgtgaggttccgatgtagtgtagaactagacatgttagaacttgttgtacatgacttagagaagagaaacttagaagtataagatgaatatatgatcccctgtatactcatgcatgaattgtgcactttaggcatagtatttccaactatggtaaagcattaatgtcaaatgaatagaaatacatggaaactagagatttcttctgaactaactttaatgctaaaaactaatggaatatttaaaaacctagctttatttggctccacatctatgtcaatagatgatttcattgaaatgcagtaagtgctaggatagacatgcagaaggttctagggatagagagtggggtgatatccctggcccaaagggagtaatatttcctggagatgacacccagactgaaccttcaaacagcaggagttagcctaataaagaaggggagaaatgtttcygacagagggaatagcataagtaaatgctgagagacataaaatgacttggagtattgtaaagagtttggtatcacttgtgtgtgtgtgtgtgtgtgtatgtgtgtatatgtaaggtttggtggtttttgtttagagatttggctttaccctgagggcatgaaaagagtcattaaagggtttgaacagagaagaacccataaagagatggattttaagacctagcctattaattattaactttaattatttgcttcctaaacattgtgtagttcaagtctagtcagtatgataatttrgaagtcagttgcaatagtctgcacaagaagtggtgaaaacttgaactacagcagtggtatagagatggaggaaagagaatgaccccaggaatatgtagggaataaaatagtcaggacttggtgcrttgattgtagatttgaaaattgaaagagagggaggaatcaaacttgttaaaatacctctttattgagcagcacagggaattagtatgtttatcttattgggtcttggaaaaggaggagactgttgcttcatgttgaaagccaagagaataaaaggcagggggagaataagggctggtgggggttgcctttctataaccctccatgagaggtagacatctctctctgtgtcttaccttcctatcctactcacygtactagtggtcttcaaaaactttttttttttttttggagacagtcttgctcttttcaccaaggctggagtgcagtggctggatctcggctcactgcaagctctgcctcccgggttcacgccattctcctgcctcagcctcccgagtagctgggactacaagcgcccaccaccacgcccagctaattttgtttttgtatttgtagtagagacggggtttcaccgtgttagccaggatggtctcgatctcctgacctcrtgatccgcccacctcggcctcccaaagtgctgggattataggcgtgagccaccacgcctggcccaaacttctttttaaagtagtaggaggacccctttatccaaacaaaatcttactatgtaaaaccccaggatatgacagctaaaacaggtgaagggacctgaggcacctccacagagcmcctakgactctacagaatagtttgaacagcagtgttgtagtgtgaacacagctgaacttactcctaccttcccaccccaagcttcagataaaagttgatgtcagaggccctgtagccaggggctgagagagtggtggtatcctcagattatagcagtgcacttgcttcagaaatgatttgctcttgaggcatgtgtgaatttaagaaaggtaaaatggatgaagtagttattggccttcatcaatcttaattatcttgccctaccagaaacagmaggatgaattggggggaataccagccagggagtctagaggtctagtcctggctgtgaccttggctggccacttgaccttgagcccatccctgaacctcatctgccttggtttcctagcctattaaatgagaactgggtgatctctgaggtcccttctagctctaaaattctattaatttgaagtagccagctttttgggaaaaggtttttgattgaagatgcagtctcagagattagtgcctgctcatgagaaatgtcctgaaagtcccacagagggaatagagatggagcacagcccatgttatttataaacccgtcttcatcattctctagctagacatagcacacttttggcagtaagtttttagtgggaattttccatgaccttttggggtttaattttggctatatgaacatggtgataatggacaagtacctctgaccractagaactgcagaatgtatagcaaaagtaagagttgtctgaggtgactcttttgcaaagtttgagagtgtagcccgtgttctaacccccatctctgtcattttttaatttttatttttagagatagagtcttcctctgttacccaggctggagtgtgctggcatgaccatagctcagtgcagcctcaaactcctggtctcaagcaatcctcctgcctcagcctcccgagtagctaggactacaggctcatgccaccacatctggctaatttctctgcctctgtcatgtagggtggcctgctcaccatttctctgctattgctcaccatttctctgctactgcccttctcttccctgggcctttgctgatgtattagttataaatggctgcataacaaattatacaaaatctagtggcttaaaacaacaaacatttattacctcgcagtttctgtagtagcagcttagctgagtggttctggctcagggtctcacaaggttgctgtcaagatgttatctaggggtatagtcatccgaaggttgattgggcttgagcgtctgcatccagccccactcacatggctcttggcagaggcctcatgtctttgtcgtgtttctccatagggctgcatgaatgtcctcactacatggcaactgacttttcccagagcaagaaaattagcaagagaaaagttacaacctttatggcttgatagcagaactcattctccatcatttttcattttttcatagtctttttttttttttaaggggctcactacattacccagacaggctcaagcaatcctcctacctcagcctcctgagtagctgggactacaggctcacaccaatgcccccaaccattttgtcatagtctacttgttagaaggaagtcactgagtatagccattacccaaggaaagggaaattaggctccatcaaagggaggaatatcttaaaatttgtgggcaaattttaaaaccatcacagctggctctgggagtacttttctgaccaaggtagtatcataacaggttttattcaagtgtatatctggttagtcaagaacttagttctcactcacaaactggttcttagagctgggtaactrttgctgtcttattccccccttgaaatatatttaacagttattagggaactggatgaagaggaataatgtgaacatgtacattaatttattcagtaaacattcaccagatgtcactctgcagagatataaaacaaaccacggtctatgtctttgaggaatttgtactagggaaaatagacaaaaaaagaaaaggaaaaatacaatacagtgtgataaatactatgacagtggtaagcacaggatgatttggtacacagagaaggggcacctaaccaagactagggacttcaagaagttaaggaaactttctggaagtggtgactcctgggcgagggcccccacccaccacacaattcagacaagagctttgtggccctgtgcaagaaaggacctcattattctttttaccttacagaatgttgctgaggcacagtgcatcgccaaccaagttcagctcttytacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgacsttatagctcccaaatgatgagtttgtcatctttatgaactcatgacaggataataagcttgaagacctgctrtagttagatatgggctttaatccttcccakgcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaatcctggtttgcatgatttttttaaaaacaactctaaacatgatacgaaaaagtggatgaaagcaaatgttcccagattggatgtggggaaaatatagcaataattttttttttaagtctggcttacaatgtttgttatacaaaataatgaaatctgagttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttctgaacccaaggcccccagtattgttgtcagctgcctttaccatggcatttctttctctttctttttttcctgagatgaagtcttgctctgtcttgcccaggctggagtacagtagcgtgatctcagctcgctgcaacctctacctccctggttcaagtgattctgctgcgtcagcctcctgaggagctaggattacaggcrcatgccaccatacctggcttatttttgtattgttgtagagacagggtttcactttgttgkccaggctggctggtctcgaactcctggcctcaagtgatccaccaccttgrcctcccaaagtgctgggattacaggtgtgagccaccgtgcctggcctgacatttctttattgatctaacatgctccactctgctgctcctgcctaagatctggttatatgacactgaatgtggtgagtgggaatttaagcagtattcgcagtttgtgtgtgtgtgttttcttccttccagaagaatttttataggttgggcctgtccctaagctctttaaatagggtggacatcccactattctctgagccgtgtctattttgttgcacctttgagtctatgtattgagagagacagatagtatttttttaaactggggaagctgctrtcctttcactatttctctaaaggttgagctgttaactaatgtaaattctggacctgcttctggtcctggcagtttatcttttgagaaacttgagtcttatctgccctgccattttcattaaatgccttctgaccttctgaatgttttgggtcccaagaatttttgacatcagatggggttgtttttattggtatccagttatgtttgcttgtctttccagatgggcccagttattagccatacatagtacattgatacacctccaccagcgggtgaggaaatgatggaaaaaggagtaagaagtggccattcgttttaatcattcctcctggatttgtcctcagtccccaactgccaagtaggatgtgtccatgkataaatgtgtggggcatgactaaagtaccacgtagctgttctttatatttatttacctagaaagatctggcaaagaactcaaagaaaattgtaccatttaatcagtaaatgtgtcccctggtgctagcatggtgttatagaaagtggacaggctttagagttaagtgaatctgggttcatatgttagtgttgctattcattagctctatactgttgaacaaattgcttaaactatctaattttggggtttttttttccatctaaaatagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaaccactgccttatctattctttacaaaaatgtacattgccaggtctttctttcctgtggatgctaactataggatatttaggttcctctgttctttgtctcccatagtggccccctttgcaaactccaaatacattatatttatttattcttgtgtcttttttcccccactagactgtgagctccttgagggccaggacttatctctgttcgcagtgccaaggacatggcctggaccatagaagatactcagttttttgttgaataaataggtaatatggatttcaaccaaaacattgtcttgtgtatgtacctgcatgtaaatactctagatttaaaagaatctcttaatacacatagatcgagaatttgttgagtagaaatatttgcaaaccaagataccaagttatacacagttctctgtacctcacctaatccactggcattaccttggtggaccattacacagtacaacttaacagctgctcacagagcatctattctgcagccactatgttaagtgctggacacagaaagatgagtagagtatgattcctgctcgcaagctctgttttagccactgcctgtttctctcttgcctctgattcagtgcctcacacctacacctgattatagtttgctttgtctagttctcggatgttcatactggtacttctttcttctccaaccagtttggaagctggagccacatgttttgctttgcactctccatactgaccttttgttcagtcttggagaagaggtactaatgcccacttcctagtcatttgatttggcattgagtcagcattcattcacacttattgagcacctttttgccaagcactgttataaaaaactggataatatagcaatgaacatggcaaataaggctcctgttctcatgtagtttatattcttgtaaagaagacaagtaaatcaataaaattattttacatactggtagtgctatgaaaatttaaaaataatattttagactatggagtggaggcaataacttaatggtcaggagaggcatctctgcagcagtggcagctgatacatgagctggggaaagagaaccaggtaaagagaacagcaagtgttaacgccccggagcagagccaagctaggaatgcttgtttctggacaaatataaagattcagtatctaccctttaggagcctacagttcagcggcatgacctgacatgaatgattacaatacaagacaaactgatcaatgccgtctcagaaggggcaaagagagttaaggaactccccccgcatgctatggaggatgcaaagcttgccaggctctggtacccacccatgaagcacttatggcttaatggggaataacaggtagacagtgttaaagtctcaaaggctatatgtttcttgcaatagacaagaggtactgtgggttcagtgctggcctcccaagctacagtcacgtactacataacaatgttttggtcacgttagattgcatatgcaactgtggtcccataagattataatggagctgaaaaattcctattgcctagtgacatcatagctgtggtaatgttatagcacaatgcattatgtgtttgtggtgatgctggtgtaaatctactacaccagcatagtgtataggggtatagggtataaaagtatagtgtacaggggccgggtacggtggctcacgcctgtaatcccagcactttggaaggccgaggcaggtggatcccttgagtttagaagttcaaaaccagcctggacagcatagcgagaccttgtctctacaaaaaaaatttaaaaattaactgagcgtggtggtgcacgcctgtagtcccagctactcaggaggctaaggtgggaggatcacttgagcccgggaggttgaggctacagtgagctgggatcacactgctgcactccggcctgggccacagagcaagaccctatctcaaaaaataaaaaggtatagtgcataaaactatgtacagtacataatgcttgatagtaaatgactattactggtttatgtatttactgtattatttagagtgtgctccttctacgtataaaaaatactaagtcaattgtaaaacagcctcaggcaggtctctcaggagttgttccagaagagggcattgttcttataggagaggacagctccatgtgtgttattgcccctgaagaccttccagtgggacaagatgtgcaggtggaagtcagtaatgttgatgatcctgaccctgtgtaggcctaggctaatgtacatgtttgtgtcttagcttttaaccaaaacatttaaaaagtaaaaaataaaattttttaaagaaaaaagcttacagaataaagatagaaaatattttatacagctatacagtgtgttttaagctaagtgcaattataaaatagtcaaaagttttaaaaattaaaaagtttataaagttaaaaagttatagtaagctaaggttattgaaaaaagaaaaatatttttataaatttagtgtacagtgtttataaagcctactgtagtgtacagtaatgtcctcctcagtcttcatattcactcagaactcactcactgactcatccagaacaacttccagtcctgcaggctccattcattgtaagtgtcctatacagcaatatcattttttatcttatactgtatttttactgtaccttttctatgtttagatacgatagataagtatttacccttatattacagtgtccacagtattcagcacagtaacatgctgtacaggtttgcagcctaggagcaataggctatatgccatctaggtttgtataaatacatcctatgatgtttgcacaacaaccaaatcacctaatgatacatttctcaatgtagtctccattgttaagcaacacttgactatatacacattaacaataaccactaacatttactaagggctaaccatataccaggcactgtgctaagcccttacatggattatctcaatcctaccaaccctatgaggttggcaggaacctgctggtcagtgacatgtgctgctctctccttgtaccctcatgccccaactccagctcagaaaagagagcaaccagccaggcacagtggctcatgcctgtaatcccaacactttgggaggccaaggtgggccgatcgcttgagaccaggagttagagaccagcctgctcaacataacgaaaccccctctctactaaaaatacaaaaattagctggatgtggtggcacacacctgtaatcccagctactcaggctgaggtacgagaatcacttgaacctgggaggtggaggttgctgtgagcccagattgtgccactgcactccagcctgggtgacagaatgagaccctgtctcaaaaaaaaaaaaaaaaaaaagtaagtcatggttggctctggaaccagccctgagaaacatgtctcccaattttcttgctggtaactaaagaacaaaatgcatgcattatatacctctgattcctccagacaattttgcaagacatcatgttctaactagggaagacttccttcggagaactttggtcttgtcaattcttctgatgtgacaggttgataacaacatctttatccttgttctgctaaaagggagagtaggagcacagaaagggaagagatgacttcaaggttgctgtctgcatcaggagccaacccaggaataataataagtgtgtccatgctccacacttaataggatcatttgtaatgtccactgagcaggctcattcttcacattcacttgaacagggctacttctacgctcttcaggctttaggaactggaatatctacaagaaaaattggttcaaaccacttaagaatcattacaggttccctagggctttctggacaaagtccttttagatcagctcacaggagcttcaggatccagtgcatggtgtcttttccaggctcattttgtgcctctcctacctactcctttggctccagccattctggataacttgcagttccctaaacacattgtgctcttcctacctctgttctgctcttttctaatacatttgcctgcttcaaatgcccattcctccttaagttaattcaaagcttcactgtagtatccctatgagaagccttccctgagacctattcccctccacatggcccccctgcaaggctggcttccccaccagaatgaatagcccttggagactgggatcatatcttactggacattatattccaagtgtccagcacgaaacccggcagagggataagatactctgtggatgctgaacaaactccgtttgagtgaccactaaactcagaccacctgagcctacaaacatcgcttgcacagtgagatccagctctggcaaacacattgtggttatgtcccagcccaagacagtggtcattttgcttgctcttattgcagaggctacatatggaaaaccaagccaagggaccaacagagaaggcagtcaggtccagggtttgtaagcagaaagaactgagagatgatgatgtgaacaaacttttggagcaaaacaattattttaagtaccaggctggcactttcaagttcttgtcttgccttgccaaaccttaacattaaaaaagacctggttgggttggtggctcacgcctgtaatcccagcactttgggaggccgaggcaggcagatcacgaggtcaggagatcaagaccgtcctggctaacatggtgaaaccccgtctctactaaaaatacaaaaaaattagccaggtgtggtggcaggcacctgtagtcccagctactcgggaggctgaggcaggagaatggcatgaacccaggaggtggagcttgcagtgagcggagattgcaccactgcactccaacctgggggataaagcgagactcgtctccaaaaaaaaaaaaagaccttacaggctgggcgcggtggctcatgcctgtaattctagcacaaggcgggcagatcacctgaagtcaggagttcgagactagcgtggccaacatggtgaaaccccatctctactaaaaatacaaaaattagccaggcatggtgacaggggcctgtaatcccagctactcaggaggctgaggcaggagaactgcttgaacccgggaggcagaggttgcagtgagccaagatcgcgccactgcactccagcctgggcgacagagtgagactcggtctcaaaaaaaaaaaaagggtggggggtgggcggccgagagcagtggctcacagctgtaatcccagcactttgggaggccaaggtgggcaaatcacaaggtcaggcgatcaagaccatcctggccaacatggtgaaaccctgtctctactaaaaatacaaaaattagctgggcatggtggcacatgcctataatcccagctactcgagaggctgaggcaggagactagcttgagccagggagtcggaggttgcagtgagccgaagcctggcgacagagcaagactccatctcaaaaaaaaaaagaaaaggccttacagactatccagtcaccagttttcaaactgtgcttcaagaaatccccaaagtccagagatggggaccttgggattctgacccccaactcaaccagagaatctgtgttttatttactgggcttctcataagctgtcatctgaaaaaacagttttcaagaaagactgaaaaaaaaaaacctggtctagtctaattctcccgcccaccattgtaggcctccctacagcaccact

SEQ ID NO: 12472 - DNA, 21313 bp, Homo sapiens
  misc_feature (1)...(21313): n = A,T,C or G, or insertion/deletion polymorphism (see Tables 1-2)
tttttttttttgagacagtcttgctctgtcacccaggctggagtgcaatggcgtgatctcggttcactgcaacctccacctcccaggttcaagcgattctcctgcctcagcctcctgagtagctagaattacaggtgcgtgccaccacgcctggctaatttctgtatttttagtagaggcggggtttcaccatgttggccaggctggtcttgaactcctgacctaaggtgatccgcccacctcggcctcccaaagtgtgagccaccgcatccgggctttaatcaagttttaatctccttagaccataatttcctcacaactggggtaatactctcatagagctgttgtaaagattaaacaaaataatgcatacgaaaatgtttggcaaatggtaagcactcagctattgttactgtaagtttgtggaaagtaactggaagtgtctttgaaggttttggagcaagagtatgaataacatggtaaaataatgtttggggaagatgaaggtgatgacactgtataggatagatggaaaggggacaacatcagcggcaaaaactcagtgaatagactcctaaaataatcagggtctaatacaagataaatctgaataagaatgatggcaataaaaattaaaagggagagatgaccagatatgagacattacgaaagtatctacatggtttggtaacttactggacatagacatggagggcaagataaaacagccaaagatgactaaaaagtttcaatcctgagggattaggagaatgagggtgccactgatcaaaatcaaaagtcaaaaggaagagctagttttgataggaaaaaaaatggtttgtattcatgtaggtttcatttggttaccaacgggaaaaccaccaccttgtctggagagggagataatgtagtgaacctgaaatatattgaacatgggaaaagctggcattaatatttaaattggtagggacttttgggtatttactgggacccattctttattttcttctgcaacatccttcctttccttctctacttcacaaatacctgttgttatcactattatgtctgttgaatttcgtggtgaaagaagcaaacaggataggggctaaaatttgcctaagacagagagctcaagagcacttagaaatcagctggaggccaggcatggtggctcaagcctgtatctcagcactttcggaggctgagttgggaggattacctgaggccaggagtttgaaaccagcctggtcaacatagcaagactctgtctctacaaaaggaaaattttcaaaattagccagttgtggtggcacaggcctgttgttgcggctttctggggaggctgagacagaaggttgccttgagcccagaagttcaaggctacagtgagccactttcgcaccactgcactccagccagggagacagagggaaaccctgtctcaaaaaaagaaaaggaaatcagctgggggcagggatgggtgtgggttgggacagcaactctggtcactcaccattccaaggtggaggcttccagtgggctgtttctttgcttgggtacataacagctcccccaaactgctgtgcccattccacatctggctgccactgccgaacacctctggggagtcaaagacagatcctagacaaagggcctgaacagtgtttggttcctgtgttcccattcactctcaaggggacccaggaaggatgacctgtttttttgttttgttttgttttttgttttttttgagactgggtttcactcttgttgcccatactggagggcaatggtgtgatttcgactcactgaaacctccgcctcccgggttcaagtgattctcctgcttcagcctcccaagtagctgagattacaggcatgcgccaccaaacccggctaattttgtatttttttaaagacgggggtttctccattttggtcaggatggtctcgaactcccgacctcagatgatctgcccgcctaggcctcccaaagtgctgggattacaggtgtgagccaccgcgcccagccaatgtcctggattttttaatgccaagtcactgatctgaagttaatgtagcttcggcaaaacaagctggaactctagaggttccattcctactaacaaattattcctggaataactccacccatcacccctgggcatgcaaggttgggatcctagcttcttcatattttcatcatattgatattatcaaccaggtgaatatgaacgtgagaaaagtgtttgttcaaggtcaacgacagagagacagcgagcattctggctctttggctgagctctactcaggtatgacaggagaggtgcattcaaattactgaagctaaaaagcagagtctcccactccgctgatttcacctcggcacgaacgaactctagaccctctcccctccctcgccagagtgggcgccactgcatcccgtagcccaagaaatcagggatggacaatggggtcacaggcttgggttattattttctgggggagtaaagcgtccccaacctgagaaaccctagccttggagaaagtgtgtcgagagctgccctcgatctcacctgctgggctgaatcggcaatcggactccagccccaggccgcagcacctgggccgcgacgccccggaagccgcacaaagccctcagcgccgccatcttactccggctgcagactgcgggaaggagaaccgggcggaagtaactccagcgcgcctccttcttggcttctcacctattcgcacagtgaagccgccctcttggaagctggcagggtcgtttaccgtcgaactgacaacatccgggtcctgtgactcggcttcacttgcgtttagataacagtgaccgcggtcatctttactgagggcgtttcctcccacagctcctggctggcttttctaggagcgagcaagggaaaattgccgttcctgcgtggggcagatacttcgtgctctctcgccgagcccgcctgcgtatcttggaaacgcgcggcgcttccttccctactcccttccgccttggccgccctcatgctttagtcctgctctcggattgtatctgagccctgcccttatagggtagccccaggctttgccaattactttcccatcactgaatccaaaagacaggagttgggaaagccagctaatttccagatgtcataaattgagattggagaaaggagcctaagtggggctgggcgggtctgagagctcccgccaaaccaaaacaaaaaagaataggatgccaaggccgccggcattggtggtgcggaggggagtgtcggggtgtgtaggagccacctcatcccagatgggggagtggaggtcctctgtgggtgaccctgacatcctccaggcttcccgaacctacagaatcacagacccaggaagcgcccttagagatgcctcacaccccacttccgtcttgcgtcagcctcttttccctaacgtctttctgaccctgctatagccctcctgggtaatggccaacagcacggaaatgtagtagcaccaggagtctgatcacaattctgtatggacaaagattcttccagccttagaggctagttcctgttttctccctctgcctctaagcccaactccagctgggccacccacccgtagagtttgtacaactctccaactctgagcctggaaagaggccttccccagatatcccctagacaggatcccagggacacagcccaccagcagcgcagcagggtgaggcagacagaccaggaagcagagatggtggaattcttcactgcagagaaagaggggaaagccagacttctggcctgggaattgacctaatgggaactgtaccaaagggtggggccagatccttagctgtgggaactgaccaggacctgggctagacaaggcagctgccacagagccagggcagaggtttggtccctctgttgtcctcattccttgctctttccctgggccttctttctattgttgaaacacagcaaatgtggccatggtggtgggggatgggaaggactgcatttatttgccttgatccagcctgggagaagtcaggatagactttgggctgcttggccctggaggcagcttgagctgggactggggtggggggctcctgaggggctgcctaggacactgcagcttttgtgccttctccctgctgccaacacccccacacacactgctgcagccactctaaagccctttgtctttcattgcttagtcaccccctttgtcctcatctcaaataggggagtggaaaggggcagtagagttctctggtgatagctcctcttgcccctgccccttctggtctcccaccctttgtccgactcctctagtcccagccccgttggcttagaaccagggtcaggcaagtggtgggtcaagaggtgggtctggcagtcacaagggggtgggtgatccaggaagtgataggcaccagggcaggtattaccgacctgagcaggaagggagggggaaaggaagtattctgacggatatgatatgcgggggacaggaggtgacaaagcagagtgaataggggaatagaggcaagaggaggtggtccacttctgggaaaggaaagagactgctgactgcactctccttcctggggatttcctggggaaacaagcagccagaggatggggtgagcagaaattgcccctacttctgaacccttccttgccttgagagttcatacccaagacctcttttccgagttccctcctatccaaagccaaaggaataatttgcttcctttccctaacaccacctcttcctccccagccactttccccaccccaggcaatggatttctcccagtaccctaatttccctatatgcacaatgctgtctccaccctctccctgccccagggagaattaaaaagaaaagatgactagatattccaggaaccactgggttctcagagcaaggtggggtggatggtgggagccaggtggggattctcccagattgatactgggtgaatctgggttcctgagagcaagtcttgcctatgctgggggctggctgacttgaggctgggggagggtttagggcagttgggagtgggtaggagcagggccaaaagcctgggggaagctactgggagctgggccagggaaatggggagtcaggaagtggggagggggaaccctggggggaaatggaggcggaatggctgttctgggctttggagggggtgggtagtggtaactcaggaagggggatcctgagggagagaagggacgttagaaaagaggaggtgccaccctggatccgccttctataaaaggaaaagtcgttaacccctcctgccttgtcatctgccgcctctgttatgttcattccaagcaggatcatcctacctttgggcagtcaactccctgatcactgtctccttgcctcccccaatgttctgccttttttactcttcccagctgctcagttctatcctgagccatgtcaagctacctcttttatttgttcttccctcttgatgcctccttacctgttccctaccctcttttctcaggcagctcactcagtcccctcagccctggaaaccagccactagggccaaagggcagcatgagggagccttgagaaaagagaagccatggtaggttagactataagagcaggaattctcccaggaccgtgatcctatctgtgcatgccggccaggccctttccctcactctctgcctctcctggggctctgtcccaccaaaaagggaaagagacagctgagggctgattgtggggtttgggaaaaggctatgtcatcagctggcccagtgcctattatccattcggctgctagagattcccctcccctgggcaagtcccatttttttgggaagcgatgatacacccatctgagtcccaccgacagagctcagctgagtggcttagagatcagccaatcaatcgcagaggctcaccatgcttaaaagagctggcgcggagagaggctggggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcrcccctgccaggctgttgtgccgcttgcaggcctttggggagacgctgytactagagctggagcaggactccggtgtgcaggtcgaggggctgacagtgcagtacctgggccaggcgcctgagctgctgggtggagcagagcctggcacctacctgactggcaccatcaatggagatccggagtcrgtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaaggtaggcatctctggagtctgtgtcctgcggtgtcctcccgccatgtctgtcctactgacccctattcaccctctctccacccacttmcacttctggccgttctgcttccctcccttctgcctgcctttcctttctccatgagcctcctttcttggtaaggctcaggcctctccccttcacccttctcctagccagacccaccgagggttctcagaggtgrgtcacagactctgggctgggaataactgctccctctccccaccccaccccttcctggccatggcatctcctactgacacagtccccagcagtaaaggtctcctaacagccccttggccttggctcttttctctgctccaaatttgattttcatcccccactcccagctataggagtcaggtttgaggccctagggcttggtgtctggcttctgmtgctgcctttaaaatcactgtggcaaactgcaaactagggcaggagtggcaagagagggagggtatcccatacctccttctggtcaatccccttcacacactgtggccggactgcgaggctgcctgaggctccatcctttcctccctcccactcctggtctcccccttcttcccttccctcctccctcctccctctctagctttaatccagaccagacgctccctccacaaccgccacgctgagctctggccctggccctagctgctgactgaatcgttcctccaaccacacagggcagacacgttgcagcccagccctctagccctggtcccataggccccagccacactcaggcctggagaaccccaaagtccctcctgacggcagtccaggctgctttcacctctggggctcccgcagccctgggatgtggcgtccccttctcctccccttcttagaaccagctgctgactcctcagagttaccacaaaagccctgagatttggcgttgggggaagggcccaaccaagacccgccaggagtcaggaatcccgtggggtgtgtggggcccagctgactatgctgagttccagacccaggaagtgagggattggagaatcgaccgamccatgggtctgagaggctatttcaggatcttcctctccctttttctctacagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggtgaggccscagtcagcaccgcaggccatgcactgcacaattctaagaagcgccactacatagactatgatgcaaatgatgttcctggagttgtgtgacatggtgccttgccccagccacactgccatgtgtggctacctaggccctgacagtgctgggtcctcagtgcccaggtccccgggaatctggatctcaacccaatggacccaggtgtcttggctgtctatgcaccttctatgatccctctccacaggacctgtgtggagtctccacttgcgacacgctgggtatggctgatgtgggcaccgtctgtgacccggctcggagctgtgccattgtggaggatgatgggctccagtcagccttcactgctgctcatgaactgggtaaagtaggggtggatgagaaaggtattagggaggagaaggtgggggagggggtagcaagttcaccacagtgttaatgggggtcccaaggtattcttcccccaggcctaggtatagggctattactcctctctgctccaggtgtagacatacatttacatttttctattaaataaattagttggtcgaaactactgtgaactcctckgtgtgtgtgtgtgtgtgtgtgtgtstgtctgtgtgtgtgtatttggagggggagtcagagacaatgggtggggtcacagttgggaatgttggctataaggaaaagtgggtagggagggaccctgagtatattttggggaagaggagacagagaaagagacggggctacatactgggagccctgagagtaccataaaggaaaggactgggggcagggtgaggtgggtaatggatctgatcatccacagctgcagccagatttattatggagtccctcagggcatggggaagggaccctcagatcctatcagggcctttgctcccacaggycatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatggtaagcagatggcacttacctttccctgggtagcactcaattcctgtcctccagggcactctcacttccgctgcattctgcatggaccaaattgcctcccccaagtgtgcttcctctgcagtgtgggaaggggtgagaaatgctgctgtctttgtgtagttctcacttcctcccagaataaatagcatagctagaggaggcgaattttggctyagtagaattagaactgactttctgagggccagaactgtccaccactggaatgggctggctatgaaggaggtgattaccttgtcacgcagtgaggtatgcaagaatagcaggatgactgccactaggcagagatgttgatgagaagcaaactcaaatattctatagttggttagaataggcagaattgagttcctatccttactctgttttgttttgttttgttttgttttaaatacagatgtggtctcactgtgttgcctaggctggtctcgaactcctaggctcaagcaatcctcccacctcagccttccaaagtgctgggattacagacattaagccaccatgcctggcctcttattctgttctttaagcaggtgtagatgtgtgactgtaagttacttcacctctctgtgtttgtagttgatatgtcagataagtataatagcggtacctatctcatagktatttgccatgattaaatagtgctggtcaagcatttagccaatgctcatctcataataagcatccaataaactatagctgcccattaaagcctcttacagggctaggcacagtggcttacacctgtaatcccaatgctttgggaggctaaggtgggaggattgcttgagaccaggagtttgagattagcctggacaacatagcaagaccttatcactacaaaaaattccaaaaaattagctggacatggcacatgcctgtaatcccagctactcaggagcccaaggcaggaagtttgcttgagcccagaagtttgaggctgtagtgagccatgatcatgccactgtactgcagcctgagcgacagagcaagactctgtctcaggaaaaaaaaaaaaaagtaagtaattaaaayaaaaattataaataacaaaaatttaaatcctcttatagtcctaggattgtttttctaggctccatcaggccccagggagcctaagctttctgctggcaatcctgaatgctcccctcagcccgttgctgactttgtgccccaacccccttcccagggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatgtgagatcctagggcaggggtggggtaaagggcccgggggtgtggggactggccttaagcccaggagagagttcacttatgccccacttccnttctgtgcctttgcagattccacaggctggtggctggggtccttggggaccatggggtgactgctctcggacctgtgggggtggtgtccagttctcctcccgagactgcacgaggcctgtcccccggaatggtggcaagtactgtgagggcygccgtacccgcttccgctcctgcaacactgaggactgcccaactggctcaggtgaggagtaggggggatgggagcccttgggaggggacagtagagcaggaaggactgtcccttgagtgcaagaccaagggggtgttkattcccctgctgctgtggggagtgcctttaacctctgggaattgtccttggccgtctgcagggaagagcagagctgtgctgtctagagttctcaggggttgggtggagggatgtggggtgatgtgaggaaggaaggaggggctctgactgttttacccctccagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccrggcactgggctactactatgtgctggagccacgggtgagggtcaggacacccccaggccctgtctatggtcacacacacccgcagtgctccctctgctttctgataacaaagatcacccaaagtaaccctgttcctacagccacgccagcccagtccaggattccactcagacttatctgtacatgggtatcaggaaaacgagccccagactccagatatgtggccaataggtccctctagcctatcctatttcccgtggtttcttttcctctgactccccatcttctaatgctgcatttggtgagaatcgaatgtgtggcctttgggacaagtccttcacccctcttccatgggctcctctgtcaamttatagtggtggtttcattcagctcctggacagccagtccctcaatggacaggcctcctggagatgactgaagtccctacactccctctctgtgatagggtggtgggttgaaggctgcacaaagaaaaacaagccccagcagcattttgctcccttcgccccaacctgagaatttctacaggctggctgccctctagcgtccatttagggacagtgccatcaaggtttagggcttggtgctgggaccagacagactgcacttcccatcttggctcctctgcttgccatttgtgtggcttttggacaggttctttagcttttctaaacctcaacgttccatccctaaaaacctcaaatagtggtggtgagatttacatttgtgtttataaaacacttagcatgctgcctgattcatactcagtgctctgaaaatgctggctagatgttatatgtgataataattattattgttatgattatcacccacatggtggcyggcactcacccatctacatcccctacttcatccaacttttccgacaacattgcttccctgatgggacatgggtctcgtttgatttaccaaccccttttgacttaggaggaaccttcagcattgttctttctcttttcctcaggtggtagatgggaccccctgttccccggacagctcctcggtctgtgtccagggccgatgcatccatgctggctgtgatcgcatcattggctccaagaagaagtttgacaagtgcatggtgtgcggaggggacsgttctggttgcagcaagcagtcaggctccttcaggaaattcaggttctttcaccatcattcctccctctaccttcctggacattctgggtcctagtgatgcagaggggaactcagcactgtttccactctcaaagagctcacagtctagcgggagatagacgagtaggcagctacagtgcggtttcccatgtattcatccgaagttggaacagggtgttgtgagtgcccttgtgggcatcagggaaggcttccttggaggtgacctctgagctgagtctcagaaggagggtaggaattagacaggtaccaaggaagtggggcttggaagggcaactcaataagggggcagtgggtgtaaaggtccagagataagaggcagtagggcacatgtgcatgtagctctgatccagaccgaacagctcacataggattgggtgacagccatctacacacatgtacacacatacagtcacataagcacagctcagaaggctgaggggattcaggtgatcctgagctccccatctactccttccacacaggtacggatacaacaatgtggtcactatccccgcgggggccacccacattcttgtccggcagcagggaaacsctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcargaaataacctcactatcccggctgccctttctgggcaccggggcctcggacttagctgggagraagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccggctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactcagcatctagtaagtgctcaacaaatagcagctgctgttacttactgttatcaaatttctgtccacatccactctccatatgcacttgaaggtggcaaagatccacaaccatggtgcctgcctttatcctcagggtccgttcctttggttggcagacccctatcctgggttctgagggaccaacagagaaaggaaaattccatccctcacctctggaagttcccaatcacaggaaggaaacatagtaagcacgtggctacaaatacaattgacaagaacatgaaggtgcaggataacaagaacaaataacaagaacaactgcatcaacacaaatgagtgcttagtaataagggtgatagttgaggggtctgggtttcacaacagtagaaagagcactggagtgggagccagcgggtctggattcaatttggggctcggcgtcttattagctgggtggtgttgggtaagtcactgatgctgagccttagattgctcatatgggactaacagtatctactcccacagagttgttctgggaacaaatgctagaatattttcaaaatagtaaaggttatagtcatggccatgtgagaggttacccctatgactacctgaagatggaacggagtctccagaatctgccagtgtaaacccagcagaatgcctagaagatgtgagattagaataaaatttcataaaacaaaaacaatcgggcacggtggctcatgcctgtaatcccagcactttgggaggccgaaatgggcggatcacgaggtcaggagattgagaccgaccatcctggctaccacagtgaaaccccgtgtctactaaaaatacaaaatatatatatatatatatatatatattagccgggcatggtgacaggtgcctatagtcccagctacttgggagactgaggcaggagaatgacttgcacccgggaggcagagcttacagtgagtcgagattgcgccactgcactccagcctgggagacagagtgagactcgtctcgatacaaaaacaaaaacaaaaacaggatatggtttggcaggaaataggcaagaaggcaaaaagaataacctggaaaaggatctgaggtaagggagccaggtgcctcaaaatggcagaatacctgatgcctgaggagagggagggaataaaacatctgcattttcccctctgggcaaggcgcctttgcttgagaaagaattttgggctggatgagatggttcacacctgtaatcccagtactttggcaggaggattgcttgaggccaggaggttgggaccaacctgggcaacatagaaagattccatctctaccaaaaaaaaaaaagattgaaaaattagccgggcgtggtggcacctgtagtcccagctacttgggaggctaaaataggaggactgcttgagcccacgatttcgaggctatggtgagctacaatcatgccactatactccagcctgggtgagagaccaaaacaccaactcaaaaaaaaaaaaaaaaaaaaaaaaagggccaggcatggtggctcacacctgtaatctcagcactttgggaggctgaggttcaaaaccagccaggccaacatggtgaaaccccatctctactaaaaaaaaaatacaaaaaattagccaggtgtggtggcaagcgcctatagtcccagctactcatgaggctgaggcaggaggatcgcttgaacctgggaggtggaggttgcagtgagccgaaattgcgccattgcactccagtctgggcgatagagtgagactccatctcaaaaaaaaaaaaaaaaaaaaaaagaacttgggcagtcctctatgtgtcatggatggaacagggatgggcaagggtggtaggtagaccctgcaagaatttggagttttgagaggcagacgcaggactgctagggattggggaaggtactggatgtggggttgtgggagaaactataggtaaagaagaccctgaggttgaggtggaagagtgaagaatgggggaaccaaaggcacttcactctgccatagcagcccctagctgggatgccaaatactgcttggaatgtgaagctgggactatggggttgaggcaggccatggaggttgtagtggttatatgtgctatgcttactggatctgggctttgctaatcaagttctgtaccaggcagtgccttatacagcaccctgtactctacaccagccagcacagcgcctgcttcctctgcagcaatgagaaaagactgcccacactctcttctctccagtaaacacggttctccctgctaggcttggccccctggcccttcctgtggtcctcctactaaccaggctgaagaagatggagacaagacaatagtgatctttactcgtttcatctagtttgcaaaatgagaccacagatagtatgtttatggaccttgatactatgagttgatggtacaatgagcagagttctgtgataagtagatgtaaggtacaaatacaaacaatatatacgactgtcctaaaggggttcacactgcattctgggcaggggaggttgtatactgctcccactccaccttccccgcaaacagaagcaatgggacagtaaaagggactagaagataagagcctaatgagccctgaactgaatggactatgagggttatggagggctaccttgggctgggccctggagaacaggtcatcatgatagcccttctcactttcctttaatgttcatggagatacacttttttttttgagatagggtctccctttgttgaccaggcaggagtacagtggtgtgatcttggctcactgcagccttgaactctcaggctcaagcaaccctcccacctcaacctcctgagtacctaggactacaggcacgagctaccacacccagctaatttacttttttttttggttgagacgaggtcttatcatattgcccaggctggtcttgaactcctggcctcaagggatcttcccacctcgatctcccaaagtgttgggatgaccagtgtgaaccaccatgcctggccttttcttttgagacagtctcgctctgtggctcaggttggagtgcagtggcaccatcataacttactacagccttgaactcctgggctcgagtaatcctcccacctcagcctcctaagtagcttggactacaggtgtagattcacttttaaatcacttttctgcctgttattttaagagaaagcccttcgctcaccaagtagggttctcactggcataagtaagtttttctgaaaatgagactgagcttaggggccacctctgtgattgggtaagtaagcaggagctagagtgaaagaggggcagagagagctagctcatcgaagagaagtgatgggcatctcagccctcaatcccaggcaaggcctgacccttttctggaatggtctctgccttaccacacctccaagacccagattgtaggtaggctttacctaataggagtccaacaagttcttgctagggatgggattgtgggggggcacatatctccctgtaagagccacagtgagctctgtttcccatctgcctacttattgccctcgtgggcctgagctggggtgtagatatataaggaggaacagaaacagtaataacaggaagtaaggaggcactgaaacaattcaagtatctggtcctggagatgaaaagaggaaatggaaaaagaaaaggcattgaatgacaagggattagaaccctgtccctagagaagttcaagaagagtttggacaaccattttatgagatggcaagtgttgtgcatgagtatgtgtttgaggtgggggaggaagttgaagcaataagttgggccaatttcctaaagtcccttctgcccctgagattctctgcttctgtggttcaaacagaggaaatctggacatttgtccagccactatttttgtaatggaggtgggacagccagggttcctggagtgtgctgtggaatcggcatttacacttctcttccatctctagtctcatttctgtaatcttcatacagtattacagtattttgttttctaaaataccagattggcagtaagtgacaaaactagcatctcattggtcagggcttgtgggggaggaagggagaagaaagtggatttcaatgtattaacattttattggctgagaggatgtttctgaaccaattgagtaccttccccattgactgttgctggggccaagccaaaatcattggcaccacgagaaaccagatgacagctggaggaaaccacgagtgctaaaaatgctcagaaagaggggggtcagggaaggcgggggagcaacaacactgaacaacttccccaggcaggatcttacatggggacagacccagggtacttaagtagcattaggaaggaaagggaggggaggaagtagattaagtatccctcacagtcttggcacaacaaacaggcaccatacacccacaccaacagtgacacattgacataacacacatccaacttcacagagacacactagcacattctctcttttttttaaaatttattttattattattatactttaagttttagggtacatgtgcacaatgtgcaggttagttacatatgtatacatgtgccatgctggtgtgctgcacccattaactcatcatttagcattaggtatatctcctaatgctatccctcccccctccccccctgcctttctttttcttcttttttttcttaagacagattctcattctgtcacccaggctagagtgcaatggcgtgatctcggctcactgcaacctccacctcccaggttcaagtgattctcctgcctcagcctgccaagtagctgggattacaggtatgcaccaccatgcccagctaattttttgtatttttagtatagagacggggttttccatgttgcccaggctggtcttgaactcccgggctcaagtgatctgcctgcctcggcctcccaaagtgctgggattacaggtgtgagccagggtgcctggccaacacattctgttgataatatagatgcaaataagtagtagggagcggaaaatgtaagaattttcacctgaaaatggatctgaagagtaaaagatattaattgacctaatcgtgcattgagaattgactgtttatcccatttatttgttcaataaataagccaatgggttgtaaacattgtaaacattccacagcatgtggaaaggacatggatttttggagtcaaattgaatctaagccttgctacttacttacctgtaatgatgcaaccttaattacttgatctctgtaaacctcagtttccttacctacaaaacgtttgtactattacctgccttatagagaggtccagacttaagaatatgatgatgtaaatgtttggcactgtgtctggcttttagtaagtggtcaataaaggccagttctcctttccttatatctcttcctttgtctgctccctgacttctaacccctgcattcacgtgagaaaacagttatatcaaggaactgtctaggtcagatctaagggccattttgtaaatttgtgcaaaaagttctggcttacattgaagggatgataaaaggaaagacatggtcctaatcctcagagttcacaatctggtggctgagacagtcaagtaggacaaaaatttcagacttctgtgataggtgccatgatcaaggaggggcacctagcacagaatatgaggccacagaagtgtttctggaggaggtgcctgtctctccttctagaagtgagcagtaaggctgggcacagtgacccatacctgtagtcccagcactttgggaggccaaggtgggaggatcacttgaggccagaagttcaagaccagcctgggggacatgatgaaacctggtctctacaaaaaatacaaaaaaaggcagggtgcagtggctcatgcctgtaatcccagcactttgggaggccaaggcaggtggatcatgaggtcagagttcaagatcagcctgg

SEQ ID NO: 12473 - DNA, 65389 bp, Homo sapiens
aagtcatggagatagagagtagaatgatggttatcagaggtgggaagggtaacggggagagggtaataaagagggataattagtgggtacagaaatacagtttgatagaaggaataagatttagtgttcagtagtacaatagggcaacaagagttaacagtaatttattgtacatttcaaaataactaaaaaagtgtaattggaattttcctaacacaaagaaatgataaacgcttgagatgggcattccagttaccctgatttgatcattacacattgtacactgtatgcttgtatcaaaatatcacatgtaccccataaataggtatacttagtatctataataattaaaatttttataaataaataatttgtttccccaaataacaccttgcttttggcttgtcagatggacaccaggtgaaactgtcaagtcaatgaggtctgtccatccctgtcttacctgctctattctctctccctggtctgtctgccctctgcattcttccaccaaccagtgctcccaccatcatctatcaaagatccacatggttgtagattccaacaggccccggggatccaagacagagagggatcatagctcccacagttagggactgtgacttacttaattcaaagtattttcattatcagacatttaataatacgtcccagagctgagagtatgctgtcagcagtagttggtagggatacaagatgacgaccttctctctgacctcaaggagctcatgctttggtagagaagaagatgtgagagaaactaataatcatacaactacacagtagtaagcactacacagagatgggatggaagagccgtgggaactgggaggagggtaggtcattctaccccaagccctctgctccttttctagaagttccctacttttcctacatctgtggagcacgtgccaggcaccacgacaagctctgagcccacaggaaagactgaaaggttgggctgatggttaagacacagggtcaatttataggatggcatttcaggcacatagtatctgggaaagagggactgaactgaaactgactgattcccttaacagctgggtgactttaagcaaattacttaacctctctgagtgtctgttctcatttctttcattcatttaacaaatatttattagatacctactgtatgcaaggcactatggacacaacagtgttgtgttttttttttgtttttttttttcctgagacactggagtgcagtggcatgatcttggctcactgcagccttgacttcctgagctcagatgatcctctcacctcagcctcccaagcagctgggaccacaggcatgtgtcaccatgcccggctaatttttgtactttttgtagacgtggggtttcgccatgttacccaggctgatctggggctcctgggctcaagcaatctatccgcctcagcctcccaaaatgctaggattacaagcgtgagccactgtgccccaccacagctgtgttttgtttgtttgtttgtttttggagacagagtgtcactgttattgctcaggctgaaatgcagtggcccgatctcggctcaccgtaacctctgcatcccaggttcaagcgattctcctgcctcagcctcccgagtagctaggattacaggcatgcgccactatgcctggctaattttgtatttttgtattttgtattttagtaggggtttctccatgttggtcaggctggtcttgaactcttgacctcaggtaacccacccgcctctgcctcccaaagtgctggggttacaggcgtgagccaccacgccccgccaactgtgtatttttaaaaacctatccttgtggcacttaggttctgctaagggaggtaaacaataacaaatataaaatttaaagctacagtatatagatggtgatatgtgatctggcaaaaaataaagcagagtaaaaagaaagggagtgcccattgtggggagagggatattaaaaagacaggtcagggtaacatctgagtagagacctggaagagaccagggcataagccacgtggccacctgggggcagagcaatccaggcagagactgtcagtgcacaggcctcaaggaggaggcagcctggtgtgttcaaggaacagcacaagctggtaaggctagagtggtgtggaggagacagggtgctgttagagatggaatctgataagagggccaggctgagcaggcctggtaagccattaaaggagcttgtgctctcactctcagtgaagtgggaagttactgggaggggaggtgggtggtttgagaacaggagtgacatgatttgacttcttatcttaaaaaggaaaatgggtgaaaaattgagactagagaacagggcagaaagcttggagggcagttacaatgctactgcagcaattcagatgctggcatttggacaaggctggtggtagtagagccagtaggaagtggttggatttggtgtatattctgagacagagctggtaggactgcttgatggatgagagacgagatgtggagagtaggagaaaggggtcaagaatgactgaacaactagaaggaaggagttgcggagctgccgctgactgggctgcggaagactgaagaaaggacaggaaagagctggagaaccgtgttagacatgtttgagatgcctaattaggcttccagtagtgacatcaaacaagcagatggatatatgggcccagagtttaggacaagttctgatgtggactgtgttttcatctccagcaagccacatggctgcctgggggcagggcaatccaggcagagatacaaccagtgaagaggtctagaggaggagcacaaggcccacgtggctagagtggtatggaggagagagtccatttcatttatgtgagttaaagttaccttgggcaaagcaatcagcagtgattgtgcacacagcaggtattcaatgatcaaggttcttttccttccccttccctgcctggcccagtctctacctcctgttcatctgagacttatttcctcagctcagatcaatgtactaaacatctgtttcttcaaggtactacaggagcctggaaaatgagagagaccaagctggcttgggctcttgacacttggatggttctttagccttgccatcttcaagtcttccccaatactactcattttgacttgtttcaatattccagtgaaagggcaagaaaaaccatcacatttcccaagagtagatataaatttgaattaataaagaaagttggttagagtttgaacttcaaacccttccatgatgtttttgtttaaaaataaaacagactcaaaatagtaacttccattttcacgtgactaacaaatagcaattgtggatttcagatcttggtacactacattcctcccggaaataaatcggaataagtcaaataccaggagttctgagaaacagaagtctctgatttgggctccattcttgcttgacggattatgggggaaaaagtcacatttaaaactcttcattctggggtggtaaggaaatgtaggcactgttctgggtccagaggtagaaggaaaactacatggtatttcacaaaatgctcaagacagtctctgtggtgtgtagaaacaggcaaatgtttatttaaaactttcagttcagtagaaggatgtctaagaaagtttttaaaaaaggcaaaaggaggctgggtacggtggctcatgcctgtaatcccagcactttgggaggctgaggtgggcagattacttgaggtcaggagttcaagaccagcctggtcaacatggttgaaccccgtctctacaaaattacaaaaattaggctaggtgcggtggctcatgtctgtaatcccagcactttgggaggccgaggcagggggatcacctgaggtcaggagttcgagaccagcctgaccaacatggaaaaaccctgtctctactaaaaatacaaaattagtcaggcatggtggcatatgcctgtaatcccagctactcgggaggctgagacaggagaattgctggagcccgagacaagagcgaaactccatctcaaaaaaaaaaaaaaaaaaaaaaaaattagccgggcttggtggtgggcacttgtaatcccagctgctcaggaggctagggcaggagaattgcttgaacttgggatgtggaggttgcagtgagctgagatcctgccgctgcacgccaacccaggtgacaaagtgagactgtgttccaaaaaaaaaaaattaaaaaaaaaaaagggcaaaaggacaagtgacctgtgtctaccccaagagccagctagaacagcttgcctggtggtagaacaatagtcttgtaggcaatggcagacaaaaatcccctaggcagctgtaaaacactggcccaacctctcaagctcctattactctctaggcgtgggacccaggcagcagtaaatcatcacaaccatcagtgctcagtggagtgagatcatctgcagggattccttaatgaaacgtgatgacttctctggcactccagcaagtggggtgtgctgaggacaccacgcttttctcaggagatcagttatcagcttttccacacgttctcctgaaccagcacacaaaacagcccacgtggcaccatggcaccgacctcaggactgtgccgagctagctggatagcttgcttgcttttccttaagttctggttaaaatgcactgtaccaactgctcattaaggtcttactgtgtgtcaagcagttgtaggtgccaaggaaacaaaaacaggcaggattctgttgtttttatgaattctgctctcatggaattcatagtccaataagtaaatgcatctgagtcaaaatcagacttccttttaaaaacgaatgtggccagccaggtgtggtggctcacgcctgtaaacccagcacttctgggggccaaggtgggtagatcacatgaggtcaggagttcaagaacagcctggccaacatggtgaaaccctgtctctactaaaaatacaaaaaaattatctgggcgtggtggtgcatgcctgtaatcacagctacttgggaggctgaggcagaaggattgcttgaatccaggatgcagaggttgcagtgagctgagattgtgccactgcactccagcccgggtgacagagagtgagtctgtctccaaaaaaaaaaaaaaaacaaaccaagaatgtggcccttccttctgctctcagggctggggatgtgtggaggagcgtgtccacaaacgaggcctacaggcacgtgtggataacctgatggagccggccccaggatgtgcttccccctttatattcatgtaggaagaactgctgtaattcataaagtttatattatcccatttaattctaacagtgttatggagtttcttggtgagaatcactctccccatttcagctgacactaagaaagatcaagagacttgccaagcccaccaagttagttcatagcggcaccgagattataaaaccaagttctctgattctcatcccaaagaaacagagaacttggtttataatcttactgctctgcaaaacctccccaagtgaccggtggttcacctacctgtccttgacctgcttctgtctgctctcaatttttcttacccgtacctccaccctgcctttgcctcaaacttcccatctccatgaaggtaatcttctgcttttcctaagccaatggttgttaagtctggtctccagatctgcagcatcagactcacctgggaagttgttagaaatacagattcttaggcctcgccccagatctactcaatgagaaattctgggagtggggtccagcaatctgagttttaatgagctttccagggattctgctgcatgctaaagctagagaaccccactgaactaagctaaaaagccaggtacctctagagtccctgtgttgccccaccatgatcacggggcccccacatacacaaactccatgactagagaagaaagccatttgtctgacaccatgcagcagtcacaaaatgcagtcacatccagtaaaatttttcagggccagcttaggcaaaagcttgaagcaagaggtaacagccctcccctttgtggtctacccttcataatgatagcccccttttctcaatcagtgcaatggcctttaattcaaccccctcccacctcatcagacccagctcttgacccttagattagaagcccaccacaatgcgagtggatgtgttcatacataaccctcttccctaaccatgaaacgtaatgaaaggctccaagctctgttcaagagggtagacaggggtacttcatctagagtaaatgctaacaataaaacgtgaactacgcaattgcgctactttctacaaattacagaacgcttccataactctcacaaggatcacaaaagctacttctgaaacagacattagaacccaggggcctatctactgtaacacgccagacattatataaattcttgttagtcatctaatggggctattataaaagttctggtcactctgtaagggcaggggcccatgtcaccagagcacactgccacataaaaagaatttctttgtcgcaaacccaggccattagaaataatgcagagacacacgactaaacaaaggataacttcctgaatccaaagtatcaagtttactgaaaagggcaggggacgacctttacggtccgacttttctttgtggagatctaatgatcctcttatctactcccttgactggctaacaggtctgtagttttctcttagaagaatgaaaggtggttattctcttattgttttaatgtctaccgcagcaacatttggaggaataaaaaaggcccatagaggtagaactgaggttcccgcacaatcactctttgcccatcaatatggaatttatgctcagttctaaaatgcacaaaaattgcatttgaaaaatgagaagctttcagaagtcggaagtgtgtgtgtgtgcgtgcacacamacacacactctcttccatatgttccagagaggtggaaatatgcacaagaagaatctgatgaccctcccattccgcctcctttattttcatttcttagaaactccttctattggaacatcccttcccacatttatatacagggatagattcctggagaagagagggagtaagattcacaaaagatctaatttggagcactaataattacagcagctgaaaagcatacgaaagcaaagagccctgttaacaaaacactatcagggcactttccagaaaacagaccggcgatgagattactactaaaaataatgaagacaagaagagccaaaatcaaatctcaactatgcagacagacttgtagaatttttcaccttcactgctacaatcagcattttttaaaaagagcagtagactgcatgagttgacaaaggaagaaaaacaaaagatagcaagagactcattctggacacacagttgctattctgtattcacaactctacaccagcaacagcagctcaaataaggcacaaggtggggtcctggacaaattcacccatgatcagaccaattatccacgctgcacttctgcacacagtaaacacccctgacctgcaccacctctgcacctcccacccccatgactgggataaaccccaccacaagctgaaaagaaccctgttttttttgtgagaaccagccagagcctaagctgtcattacacagcaaaaacctagcgagaacaaaaagccagcagcagactgatgtagaaagcccagaacatacctgaattcttcaaatgcaaacatgacctagtcagagacaatttccttagattgtgtggtagtctttttggtatggaggacaaccatttagttagtcagatggtgcaaagtgcagaaaaatgaggcggggtttccacaccccccaatattctgaagtaaaaggctttctgcagacaggggcctgcagcctccagctccgccagctgctgacaagcggcagctaacaggggaggcagctagaaaaccatgtgatcattccagcaagtctgattaatgcagtgtatgcttaggctccaggctgggaactggattagtctakagaaagaagtcgaacccagggcacgcctgggatcctgggtaaagcatgtaacacatcccaccccctaccagaactgtgcasgttggggagagaggagagaaggctgaaaggaatgagaatgcaacctgttccgctgtgatctgcctaattacctcatcttcctctggctgctgctgctataagctcaggcatgaccaacattatatgtgaacgtaagtactgaaaaattctgcagaattctgtattttaccattccactatcaaacactattttagcacaaatgcataagctgcttcagaatcacaagtcgcattttatgtccaccactttaccatgaccagcgtgaccttacatgtcactccttattagtgatctcatttatttgattattcatttatcgagtatatagtaggtacccggttctcaccaattccttgaagtacaaaaattgctataatcatttcagaagagaagaaggaggaaacgagatgccagcccccaaaagaaaaatgtttatcaggctggcaagatttggcaaatgagctgaggttgtattctgagactcgccatgaaggaaaatcttcagcattcgggttgcaactctttgtgaaataagcaaggcagatctcaaataaaaacgtatgagtcactcttgacgttttttctctcccttgaccccagtgtcatcagtcactaactgtaatcgacctggaaaaggtggcctgaagctgcccctttcccctcacccgctcacgcagcctgggtgtgccctcagcgcccctcactcagcctctggccttaggaaaattgctctggctgagttttagagaaggggtggaagaaggaaaaccagttaccaattctgattttgatgcctctgtttaaccctgcattactaactcctcacagctcaagaaataaagtctttcacgcctcttcatgacatgcaaagtcttatttctccaattctttcttccactaaaactcttcacacaccttcaaattcagtyagacattcacagttcccaaaatctgtcaggacctcccttctcgrgcccatggaccagctggatgaggttctttgctgctccctaatgtgagcygctgcccacgtgctgctccctcactgctccctctccgaggggctgagattcccacagggcagcgcactgctctctcttcttggctgccacctgcrtggcatccaacattgtgtttgcctctcctgcaaatctaagagttccttgaggacaggaatgtgtgaagttaatttctgtattcccaatgcctgacatagcacttgacaaaaaggaattattcacataaggtttgctgaatgaacctcttttgcctcagcttttatcagggagaagagtgatccagtacatgcattcgcacgaaggtgctctgggacaaatgtatcactcttcatacagttatctccgtctcgaagagaagcaagagagtccaggtcttgactcaaagaaatgcagtgacaaaggccaaacgaggccgactgacgagtgagggaggtgtctgggggaatcctgtggtcccccaaaccacacagcaatcacctaagctgatctgaaatgccttctgcagtattcatgaccagcatctgcctgagaccttctggtgatggcagcttcttggcagaatcataataacaggaaacaaaatattcaagtcattaaataactcagttttaagtcccagatctgccccttactctgtgatcattgacaagctacttaaattccctgggccttggatttaccctatataaaaccagaataatattgatactgcccacgcctctctcataggagtgttgtaagaaaccaataaagtaggagttggaaagttctttatcaaatatattaagttacataagtatcttcatcagctttattatctcacaagatgatctctaaccggacagctctgatgactgggtggttcttcttcatgaagagactaccactccttggaagtatcctgtctgctcaatgggtggctcatttaattttgtggggacctctagactctgtgcctgctctccaccagtkactcaagactctccttttgcaggtataaccagcacctttcagggcaattcataaggtcctggtagaggacagttggtagaaatggtgaaaaatcaaatcccagcaccaagctcattttacacataatattaagagattctcccaacttactaatagaagacagaggccaaagtggttaagtaacttgtccagggtcatacagctataagtagcagagtaatgacatggattccggctgagctaactccaacatgctctcctggtgtccttacaccaaygatccaaccagctcaggctgcctccagaagaggacttatttgatagactgtcaggcagcctgtggccctgcagaggcggtaggacactgacccttttgggctattttatgtagctggccaggtgaatccccaaatttcatggccaagcaagagacctgccagggctaaamaaaagtgcctcaactgttccaggaagtgagaggtagacacctcagctgacatggcattggggtccaaatgggaaccaagtctgcttcaaaggctagaaatcctcgaccacttgattactgataacaccaaagtgtcagaaacagaaacataagtgagggtccgtgactcctgacaactccactcctgtctggaatagggctcaaaaaggcacttctgtgaccacataatgtgtttttttgttgttgttgtttttgtttgtttgtttgttttagagacggagtctcgctcttttgcccaggccggacgtttgtttgttttttgagccggagtcttgctccatcgccaagctgcagtgcagtggcgcaatctcagctcactgcaacctctgcctcctgggttcaagtgattctcgtgcttcagcctcccgagtaactggtattacaggcacgtgccgccacacccagctaatttttgtatttttagtagagacggggtttcaccatgttggccaggatggtgttgatctcttgaccttgtggtccaccctcctcggcctcccaaagtgctgggattacaggcgtgagccacaacgcccagtgttttgtttttgtttttgttttttaaaggcactccaagccattcgccaacaactcaggctcagataatscacactcctactctgggacttaatttccctttgtaccatgaaagaatagccagatgttaaatttttaaattaataaataattaattwtttttttttttttttgagacagagtcttactctgtcacgcaggctggagcgcagtggtgcaatctcagctcactgcaacctctgcctcccaggttcatgtgattcttgtgcctcggcttccccagtagctgggattacaggcatgcaccaccaggcctggctaatttttattttattttatttttagtagagacagggttttgccatgttggccaggctggtctcgaactcctggcatcaaatgatctacccaccttggcctcccaaagtgctgggattacaggcatgagccactgtgcccagccaataattgtcttatttttaaaaataacacttccatggaaccctaatacatacaactgatcaaagtagaatagttccrgctgaagaaggtggaggggccctagagtccctgctgcaaggccttccctctctctaccaggacaggctcaacctgaacacactggcctaaatgactctggcagtccctgccggcgctaatgatctgtggggctctcccagctacaaactgtcacactcaccctagttaatctggattcacttcctctttctagtgtcattcctaagaataccctccctagccccagcggtactaccatggyagaacactcatctgcagttactggacatgtgagctgcccgggacttctccggagaaacaaacatggagacgctgatacaaacacaaacatgaacaggaaatggccctgggttcctgacaatgtgggaaagctaaatgagaatattttaaacaagtgtcctcagcttaaccggtaccttcgttttgcaacccatgtcttttcatacgaaatggtcaactgtccaagaaaaggaatttatgatttgttagtactgaatctcattacagttcacttggaggccaataaacagagagtttaaggccctgatgtcccgtggacttgagaccttacaatcaacatttcctctgccacttttttaggctgtggggcacacagccatgatggacgtgaagcaaaataaggactgagcatctgaacagaatctaatgtgccaatcaagtaaaaaaagaactctatttcaacatttactaatatgcacattcacttctgtgctgtgtggagatgaaacagaaggagccacaaatggaagtcagctatgatcatgactaaaaatactattcttttctcatggcccaatcaaggatctttccaatggscagggggctgagcggtaataagaggaattcaacagtgtcttcagaggcccatttctccctggtttcacttctacaaccctaattaagacccttctagcctctacctgatctcctgcctgtcttactcccttcctgcacagttttcaaccctaccaattgccagttaaaaaacccacaactcaaaaactaaaactaaagtgttcatatgatccagcaattccactgctagatatataccccaaagaaaggaaatcagtatactgaagagatatctgcactctcatgtttactgcagcactgttgacaatagccaagatttggaagcaacctaagtacccatcaacagatgactggataaagaaaatgtggtacatatacacagtggagtactattcaaccataaaaaacaatgagtcctgtcatctgcaacaacatggatggactggaggtcattatgttaagtgaaataagccaagcacagaaagacaaacttcacatgttctcactcatttctgggagctaaaaattaaaacaattgaacttgtgagaagaatgagagctaaaaattaaatttaagttaaaaattagaataggggctaaaaattgaaacaatcgaacttgtgagtagaatagagagtagaatgatggttaccagaggctgggaagggttggggatgttcatgggtaaccaatgggcaggggactgatcatattttatctattaaaatagagttagaatgaataagaatcaaatgctagtatctgatagcacaatagggtgattacagtcaacactaatttattgtacatttaaaaataactaaaagagtataactggaatgtcagcaacacaaagaaataataaatgtttgaggtgatggataccccatttgtcccatttgtaattagttattacacatatctgcctatatcaaaatatctcatgtaccctataaatagaaatatctactatgtaaccataaaaatataaaaaataaacctaccattcttttttactgtctgcataatagtctcagcccccaaacttggcatttggctcccgcacaatctgaccattgtatgcttcaacccagctctcaaacttgccaacctggcccctcggcatggccctgcactgactccgcaccctaaccatatcacctccacctgtgctgtgtggagatgaaacacaaggagccacaaatggaaatcagctatgaacatgactaaaaatactattcttttctcatggcccaatcaaagatctttccaatggccaggggaccctcggtcccggatccatagtgcttccaccttctctccacaagtggctatggaaagccacttgattctgaatccagttctactcctatctccctgagaagccttgggcaaattctcaccagcctaagtctcagtttcctcatcctaaaatggggaagacagcatgtattttgtggggatgctgtgatgtgcattacacacattaaccacaatcaatggtagctaatattatcaaatatgcctcaaaaacccatcgagttgccctcctgaccaaaaccagtctcaactgatctctaaaactcctgrattcctatcacaatcaataaccatttttaaaatgttcacacattgtcttatgctgaacaactcagttcattacgtgtcttgggaccctagtcaaagagagtccctggggatggaactagaatggctagaaggtgaggcctgaggggtttaactccccacaacctcaaagasagtccctggggatggaactagaatggctagaaggtgaggcctgaggggtttaactccccacaacctccatcagacaagaaatacacacacaatctaagtaataacagcatgcttggtatgcaaatacagcttcaaaaggaagccattacaattctgggccactatcctcaaattatccyattttgaaattgtggggagtccactagcactgaccttggttttagtcctaatctttcacaaggcacagcaattcttagtcatacattgtaagtcttagagacggtttttctcacaactcaattgtttcatgtggctctcagattactaatgaaacagagccaagatcaaaaacatctcaagagaaaaagtaaaaccaccaccaggaccataagccaaaggaagtgtcaactccatgaaaggggggcccttgcctcatccttaccattctttccccaggcctggcacacagaattgttcatctgttgagttaattaatcaatggtttgtggacttagagagatttaataaaaagatgaaattagattaagtcagcagtcctctttccagtacaaacatcaaataatagggcagattacccttttgaataagcaagtgcagctgctccagtgtcaccctgatttactgaaatttgctaattaagaaggtatttccaggaagaaaggaataatcaagaagataaaatcatgtaaagcaaatacatacattcaataaagaaatatatactgagcacctgccatgtgaccagcactgttacacccgaggcgggagaagaggtcaaagaagattcagacgcacttcaggcctttccaacagttagaaacagaccccataacctaaaaaagctgaaatgatagttagcaatggtaaatcaataccaagtatatgaagctggggtataggattttctatttattcctttagtgttactagatttttttccacttcaattcactgttcttatcaatgtcccttttgaaccctggctccattatgaagttgctgaatgtacctggagagtgaatagctgggctgtggtcccagctccattccttaacagctgagtgtcctttggcaaaacactttatctgtcagcatctcagtttactcacctgtaagttgtaaataataattcctatcctgcttcctcacacagaaatcctgaggatcaaatataataacaggtgtgccaatctttcgtaaattttaagtgctatacaagtcaacagtagtactattaacaacaacaaaagaaattatccctttgcactttgtgtcatttgagatcttgataaggcaggaattttaagtcttcatccaggccatataattagattayccttaagagcaacttactatccacgtgaccaagagamtatagataaacacccacaagtacaggaatgcagggctgacagagtatcatagtcaatttagtcaaaactttactcttgggcaatagtctaagccatccaagatgcttatatgctcaatattcttatatgctcaatatgtactcattatgtcgaagtctaattttcaaaaagctaaaaacacagctctcataaaaatatttagtatatatgtgtcaaaggctgattaatcttgcaaagttagatataaaactggttaatgtttcatttcagagcaatgaaaccataatctttgaggttatcttttctattaaaacaggaatcatttaatttctactggacaaaaatcatttgtaacatcaattttctataaattaatatctaactttacagagtctaaactctattcaaaagtaagtcaaataattaccttctccaggaatgttctatgtcccttcagtggactttccaaacaaatgcttttgagtgacactgaaagggcacacaataatctttttgccttttctccaagttttagataacatttctaaaaatcttcaaaatatctaaacatagcttatcatctattccaatgaactagttaataaaaaattctctcctatctggcccatttttgtatcttcctcattcacatgttctttataaaaatcttcaagtgaataaagtcaatcataaataattgcttagttttcttaggacaaatcatcttgaaatccaaagttgaggagggcactatgttccaaaacttccagtcctcagtgcctctctgcattctctccaacgacctcacttttggatctcctaaagatgaaaaacggaacatttgattcacaggctttgtaaattccctagaggtctggctattctgaggcagttgccataattaaccgtaatttcctcatcttcacaaacccatccctgtcacccttttctttccaatataacaatgcttggaagtcaaaaccaaaatcactacagaggtacgaacaaacaaacaaaaaacctgctgggcacagtggctcaacgcctgtaatcccagcattttaggaggccaaggcgggtggatcacctgaggtcaggagtttgagaccagcctggccaacatggcgaaaccctgtctctactaaaaatacaaagaattagctgggcgaggtggcacatgcctgtaatcccagctacttgggaggctgaggtaggagaattgtggaggctgcagtgaagtgagatggtgccactgcacgatcttgttgcctgggcaacaagagcaaaactctgtctcaaaaaacaaacaaacaaaaccaacccacactaactagcacaataatgacgaccaagttctgattttttatcttgcccaaattcctacctaaggggtctaggagtcacgccctacaaaccataaattctcatcagatgggttttattttaaccctgtatatcgtgacttactttccaatctgagtgactctggcataacaaggaagaaaatcaaaatgttttacctcaaaatatatttccttgccataccttgaaattgccctgcaaagtctcttgtgggaaaawtctgcattctatagagaaccccctcttttccctttgtttttcttccttcctttccagatccaggagacaatcaactaagagccaggcacccttttaagtctgataagaaacattttacaacgtgctctctctaaagtctgagagtttcctctgcacaataaaacttggtctccacaatcctttatcttaacctgaacrttcctttccgttaatcccaggtcttcagataaacttaaccaatttccaaccagaaaatgtttaaatttacctacagcctggaagcccctgctttgagttgtcctgccttctgaatcaaaccaatgtatttcttaaatgtatttgattgatgtctcatgccttcctaaaatatataaaactaagctgtaccgtgaccaccttaggcacatgttctcatgactgtgtcataggccatggtcacccatatttggcacagaataaatctcctaaaatattttacagtttgactcttcatcaacaacaatacgaagtcaaaaaagaaatctaattaatctgagaatgtcttcttcacatttgtattttccacagaggttagggaactggaatgattgaataaacaaataaataaattgaatggactaaaaaaacagaaagaatgaatggattccaaaggtttcagcatgttaaaatgtctttcaagaaaccaagaaaggaaggcaatttctggagactagtccagtgagggcttcagaaatgaagactacatgaatgaacactgtgggaatttcaagcatccaactggcaaggcaagatggaagacattttattttgaaggtagggagatcaaggaggggaataaatatgcacatctgaaatgaggccacacgggtgtgttctcaaagagagcagtagttcccatgttttcagagcctaaggtatggagtctaggtaccaatgcttgaccatgcaaccccttcctaatctacaagtactaaaaatgaaaaccttcatttaatacatgttctcactggagaaggaggtagagggaaggcagatataatcataaagaagttgcacaaacatatgcctaagagagttgtaatctaagaagtcttacgtgaggtaaacgtgttttgtttcctcaaaaagctaatttttctttctcacattccatttctgataatcaggacttctctatttctgatttcctactaagatgtaaaaagcagtgttttttccctcatctaaaatagcactgcttcttagtttcaaaaagttctatttgcatttcatctcatgagtcttgcagtgttgcttatattccttcttacaaaaagccccaacacccaacatacaaccatggtatttaaattaataggtacaaggacaaattgattaagaccttcccacggattgctaatgccacactgggatttgttaggtgactkactacatttgaaaatgcagttattttttwaaagatatattcatactaccatgaaaaaaatgggcatttgattattttctaagcctccttctcaagccattcaactctttcttggaccctaaagcaaatactgaatacagaagaaaaagaagggtaaaggagtagttgccttcagacactagaacaggcactgaatgaaccaaaccttgagaaccactgtgttacacgcaagaacatgagggtttcagagatttcattaatatggtaagtkacctaagaaaagagtcagtctgatctcctcactttgagcaaagaaacagaaaaacgcagcaccttgcctagggtcacacaatcacagtcagagatggaattagaactgaagtgtcctgatttctaactcaagtgtttcttctccacattagtggctctcaaaagcggggtcatccaccagccatattagcatcacctgggagcttgttaaggatgaaaaatctcagatcccgccccagaattagtgcatcagaggctggaggagagaaccagcactgttttaacaagccctcctggggattctaacgcatgctcaagtttgagaaccactgactgccctacaccagcagttctcaactggggatgattctgggccccaggaacatttggcaacgtctggagatacttttagcagtggcgactgggaaatraggttgggtgttgcttctagcatccaatgggtagaagccagagatgttgctaaacatcctactatgtacaggtagycctccacaacaaagtattatctgtcaatagtgctgaggttgaggaactctgccctacacctaatagtgggagggcagaacyaggaaagctgtccgtgcttttctttctttctctttctctctctgtctctgtctgtctctccctctctctctctctctctcctctctctctgaaagtatctatctgctttagctggaagttcagttctctttcataaatgcatcctgtgaagctgtacctccccgctggagtgcctccaataggtaaggcaagccgacacactttgagtctttggctacttctgagatcagagcctcaggccccttggccagtcactctcacagcaagcagctatatctagttcccaagggtatcacgcaaatgttggcatttttcatgagtgccatgatgtgagtagataagagagcagcacagatctttttttcaaaagtcagagttcctcctgtgaaaggaaaataaatcttggggcccccaaatcactaagctaaaggggaagtcaaactgggaactgcttaggccaaacctgcctctcattctattcaaagtcattcctctgctcactgagaaaaatctgatttgcctcctctggaaaacctaagcagaaattcaaaagaatgcaaccatttgtctctcacctacctgtgacctggaagccctctccctgcttgagttgtcctgcctttctagagggaaccaatatatatcttacatatactgattgatgtctcatgtctccctaaaatgtacaaaaccaaactgtgccccgaccaccatgagcacatatcgtcaggacctgttgaggctgtgtgacaggcgcacgtcttcaaccttggcaaaataaactttctaaattaactgacaccagtctcagatattcggggttcacattctggtaaccacgaaaggattctgagtgaaggtgcccctaacctttgacaaatctcctactggtgcttgtaccagcttgagctatctttwtggctcaaaccaacaggacaatttgctgaggcctggaagcacccctccagagaatctctgatttcccaaaatctggatgagatttaaagtttattttgctgtacaactcctttttttttttttttgatgttttacttgcttccaacacaaagaaggcaagtttttcctgcttccacgatggaaggcatgaactcctttatggagtttgagctcgcttccaacagggaagacgaatttgagatttttcctgcttcttggatggcacagagcagtcttcagactgagacccatccataggcctaggtcagtaactgaattggggttcgtcttggctaaagttaagattaacatgccgggcgcagtggctcacacctgtaatcccagcagtttgagaggccaaggcgggtggatcacttgaggtcaggagttcaaaaccagcctagccaacatggtgaaaccccatctctactaaaaatacaaaaaacccagccaggtgtggtggcaggcacctgtaatccccgctacttgggaagctgacgcaggagaattgcttgaacacgggaggcggaggttgcagtgagccaagatcgcaccactgcacttcagcctgggcgacagaacgaaactctgtctcaaaaaaaaaaaaaaaaaaagattaacaaccagctggttttatttkctccttaccattaaagcattcagtaatygtataagttgtgccatcgtttgttttgcttgactgttttgtctttgtttctgtttttgttgttgttttggtctttttcccattgggtttcatcaactctatccgacctgatcaaatccacaggaaagttccaaattatggggaacgaggcctctraagtggctaaatccccctcacccccaacacacacaaaagtgttgtcggtgtggggggkggggggraatggccagcaaaaggggaaaaaaaaaaggaaagattttttgacttaaagggctttatttacgtcacacggccacctttttgctagccatgccaaaccaaaagagtgatggctgtcgccccatgctgcagttccatagctaagggttctgccttcttttttttccaccgggacagcctgggtttggttcctaaatcaagccctttctggtttgatgcttggtacttctgcaatagtagcaatttgtgccagctgaaatatggtaatgagatttaaaaagttttttaaaagaagctcaatggttaaaagtcagtttaattaaaaggtaacatccaaggggtgtgtgtgtgtgtgtgtgtgtgtgtgtgtgtgtgtgtatttaaaaggccttcatactttttgtttttctcctaggacactgtctttttttttgagcgagagttttcttctcagttgattgaattctgttttcttcatttacttctgctgtctctcctttctcttgcaccctctgatgcatgagggaccaggacatacttatccctgccaagtaatattaggtgtcaaaatttggcataggggttacaaaactataaacccagcttaaaacagaatgatctttgcttgtataatttttaataaataagatattgatattaatttaatgaaaacagctacatcttgaattatttagtaaaattaccataacttctaatcttgtggctttaggcagtctagtccacaggcagtaaggaggtttgtttagagaaaggactgctgttgtctttatttcaaaactataaactaagttcctcccaaagttagtttggcctatgctcagcaatgaacaaggacagcttggaggttagaagcaagatggaggcggtcagatcatatctttttcactgtctctmttataattttgcaatggcaagcttcacaactttaaatgatgactgttgtagttttcataagtaatctaggtaaatgattagaataaaataattaggtaaatgtaatgaaataaatacttgtagacaaacttgtcataatttagaatctaaagttaaattaaataacagatatttcattatttaggtatattccaataaaaatatattgtaggaaaacattctaaaaaaatacatgtgtcctttttaaaaaggtgaacaatttttgtctaattcaaagcttatttaaaggttatgtataaaacaaggtaaaaggaaccaggaaataagagaaatatatagaaagttacagcaataaagaggtattttttggtaagaaagcttaaagagaaataattttatatgagaaacaatcttgaatggtaagtgcagtcctagaataaaatgactggttatttaagaaagagggacattcgggaagtccaagcatgtcatgaatggtgtatgtaagtcacaataagaggatttattaaaaagacaaaacttttatatgatcaaattaaagagaaattaaaatggtctttctagagactgagtttgatgttaaaaaaaaaaccacttacacactaaagaactgactagaacagtaacattttcttaagggattgatttactcttaataaatgataagagattgtaattttttttaacccaaagttcaacctttcttgcatcttgccattttcggttttctctcccctttttaaaggtgtgaaatagtactgccctccttcgactcattttcagttcataaaaggtttttttcccttgagttctgtttgttgtggcctgatgctaacatttgtttgttggttggttggttggttgattttgagacacagtctcactctgtcgcccaggctggagtgcagtggcaccatctcagctcactgtaacctctgcctcccgggttcaagtgattcttgtgcctcagcctcccaagtagctgggattacaggcgcacgtcaccacatgcagctaatttttgtattcttagtaaggacgggctttcgccatgttggcctggctggtcttgaactcctgatgtcaggtgatccactgcctcggcctcccaaagtgctgggattataggtgtgagccaccgcatctgtcctctaacatttttttaaaggtctaaaaggaatgttttcttccaatataatctgtgcactgcagaaggtctcttcttttgccttttggtaattggtctaacagattttacattttatcaaaataattcctatgccattattattaaatttggtttgcttaggaaaaaactgagattaaaaaaaatttttttttaattaaggttatcggccaggtgtgggggctcacgcctgtattcccagtgctttgagagaccaaggagggcagtgatcacccaaggtcaggagtttgagaccagcatggccaacatggtgaaaccccgtctctactaaaaatacaaaaattagccgggaatggtggcacatgcctgtaatcccagctacttgggaggctgaggcaggataattgcttgaacccaggaagcagaggttgcagtgagccgagatgacatcattgcactctagccagggcaacaagagcaaacctctgtctcaaaaaataaaaataaaaataaaaaataataaaattaaggttattacatccatgtatctttctgtatgtgcttttaaagtccttgtgacactgagttacagggctttgactcctgggtctaaaaaggacaccagrtcctgttaaatgttaaacagtgatagcaattaaagcctcatcttcaggcctggaaggagatgccaatcgaaataaactccattcctgagatgcagggccagaaattaaagctattcaactcctcaaggcccagggactatagtggaagaggggggtgcgtgagattgtaagggtcgattttgagagataaaataagttcagtttctctataagttaaccattaaygtcataggtacactgatgcaagaccagcatacgggctcctatgtcggattaacaagcttttcttgaagcattagccaactccttaataaaggctataaaggttataaaaggcttatggaagttatatattatggtcaagattaaaatattatagattataaaattttggaaaagaaatttaattggcttcatgctgcttttattgggcttattgtttggaaaattaagtctcctttctcaaagaatgaaggttttcacctttttatggaaatctttgagttatcactttagttaaatgaatgacttatttcataatgacttgtgatcctattttgtgatatcatgtgttttaaacccttgatattggacaaactttccaaaatcaagttataaattatgtctttttctgacctaattaatcttttaagatattaggttccctaaagtccaaaaatggcatatttggcttatttggtttaaaaattatacaggaagcattgtcaaatataaaatgctgtttggctttctttgggctgtatttgtataaatgttattggtatgtgttgcaaaattataggaaactcctataattctggtatgacttagtgcctattagcagtaataattataattgttatgttaaattattgtgtgccacagagacaataaatttccttgtcagttgtgtctctgaatatggctgccataaaaactttttgtcatctacagacaattgttgtctccttttggtcctctttagaaggtggttttaaaatcagctataaaactctaacaggtgctcttgaatgcaggtttctgataactttggagattgtgacatcaggatgacgaaaaactttcaggactcatggagagcgaaatgttcatggatatcaagcagaacaggaattaactgcatggactgaactaatagtggactgaagttatctttttgactttttgcttaaaacgttgctgatcctttgttttttagagtcaaggaaacttttcttttgagctattgacagaaactaggtatactcctatgaacaaaatttggaggatatttgtttctctctacttgattcctccagaatttggaaactatctgtgagtattcttaatgtatggcaatatagttatttgcataagtacaataaaagtttgttttcatttgtaacaggcgaaactggttattttaccaaggctttgactagaatggtatgctttcctttaaggaatcaaacttaacttacagagccaataaaatccccttgggaaaactagcctcataccttgtctacacagtccctgtacagggttcctgacctgtggtaagtaaagaatgtcactttctgacaggcccaggagccccaggttatcatgggacttcaagaggaagaaaaattcacctgactcatagttatttgatggtacaaatccacggctgggcttgtcttttaaaaagccttatctgagactccttcaatggaacaaagttccaccaaagccaattttaaaagcctatgtgagaaataattactctcgctgcactttatacaaataatctgtccaagtataataaagcaaatcagtcctaccatgatttgtctttagtaaaaacgggaaactggagagagagacgaattctatttcaaaaactataacacacctgttgctagattctagtcctaatgttttccagtttttattattttctatagtttgggctgaattctaatttttcctggctataagtttccaaaataatgttttcaattttttctttcttttccttttccttccgttttttcctaatttgaaatcactgaaaactaagctgtgcttcttaaagccttgcaaacttaatccagacaactaaacttcagaagaaaataacagcaacctatttacatacataagccactttcatacctgcctactgatacatggacttcagagtaacgtggcctctatcaattttccaggattgttgttttgtttgttgttgtttttctcccttcctccccctattttctcttcataggacatgagacttctcaacctgctaaaataatattcctaatattattctattaatataattcctaataactcaggacctacctgtctaggaataaaccatcctagccatgagagatcagacaaaacctgagaccagagactcattttcttctaaaatgctttctccaaaaatgctttctccaagagatttttaaaaagaaaagggggtaaatgtgaaagaaaaataaatcttggggccccaaattcactaagcaaaagggaaaagtcaaactgggaactgcttagggtaaacctgcctaccattctattcaaagtcatccctcagctmactgagataaatgcatacctgatcgcctcctttggaaaggctcatcagaaatgcaaaagaatgcaacagctcatgcttgtaatcccagcactttgggaggccgaggtgggcggatcacgaggtcaggagatcgggaccattytggctaaaacggtgaaaccccgtctttactaaaaatacaagaaatgagccgggcatgatggcacgcgcttgtagtcccagctgctcgggaggctgaggcaggagaatcgtttgaacccaggaggcggaagttgcagtgagcagagatcgcgccactgcactccagcctgggtgacagagcgagactccgtctcaaaaaaaaaaaaaaaaaaaaaraaagaatgcaacagtttgtctcttatctacctatgacctggaagctccatccttgcttgagttgtcctgcctttctggacaaaatcaatgtacatcttacatttattgactgatgtctcatgtctccctaaaatgtataaaaccaagttgtgccctgaccaccttgggcacacgttgtcaggacctcctgagggtgtgtgatggacacgtgtcctcaaccttggcaaaacaaactttctaaattaactgagacctatctcagatattcggggttcacacttcctattccattccaatactggtggactagctgtagatcaatgtttctggtgaaataaccaaaaatgccaggtaacacagttaagcaagcaaacaaaaagcacttctaaaggcttcaaatggctgtgaagacagtaaagaattactaggcaaaaactaaagagaaaaacaggggttccccaaaagacaaatgagcacagagccccttttgccctgagggcatctgttgatcccagaaaacacaaacttttgtgctgatggcctcacaggggaagagagtgaccccccaccacagtatgccctcttcatagtaagctccaggggtccacagacatctctctgcagaagcaatccatggcgcctcaaaggaagaattcctaccaccacccataaataaaggctgacatgttttattttaattttttaaaaagtgttagagacagggtcttgtgttgctcaggctggtctctaattcctggcctcaggtgatcctcctgcctcagccttctgaatagctgtgattatagacaggagccaccacatttagctaaaagttaaagtgctgtttattgagtacttattatgtcccaggcactgctctacattctttatatgtgtcagcggatttaatcctgagggaatggcaaagagatcttgttatttttcccatttgataaatgaggaacctgagggacagagagrtaaagtaatttgctcatgatcacatagttcaaaagtggcagagctgaycacactcaaattcaggctgcctgactccagaatctgtactcttaatcactacagaataagttaaaaccaaaagggcacaaatatatttattcctatgtgacttcaaatagcaaaaaactaaatatccattggcaagggactggtcaaataatgtatggtagacacaacagagtaccagtcactagaaatatagcccttcactaactgcatgaacattactactgttgaataaaaacattatagaaaattattataaatttataaattactataatttataaattataaagtataataaacatttccacaaatcaaataaaaaagcaaatataaaagtatagacagtatattctcacttatgcaccatcataatattatacaccacatagtgtaatagcatggtcttgagattcagagaccattactggaccttggacaatttacttcattattctaaacaccaatttcctcctgagcaaaatggggcaacattatgtatcttggagggttttttgtgagaatcaaatgatataatgcatataaagttgctcatcctagaaccatacataaacgctagtaaacacagttattccattattattatgcttttatctgtatatatgtttgtataaaaaaaatttggaatcatgttagccaaaatgctaactactactaatttccaaggcatgtcagatgatttattctttatttttgtacttttctgtattgcaaaatttgtagaatgagcaagtatgatttttacaaaactagtaacttttatagatgcagacatgtatatatatgtgtgtgtgtatgtatctcctcccagcatacagataacaatgcttgtacaaaataaatactcctctattctgacagcattaaagtgataagacaatatctcaaattagagatccatgggaaggagaaagaacaagctgaggagagtcagatcttagacccggaacaccactatgcatataataaatattttgttgtgcggagtgcaggggctcatgtctgtaatcccagcactttgggaggctggggtgggaggatcactggagccgcgtttgagactacactgggcaacacagtaagtccatggttctacaaataataaaaaaattagctaggcatagtggcgcagatctgtgttcccagctgcttgggagactgaggtgggagaattatttgagcccaggtggtgaaagctacagtgagccatgatcacaccacagcactccagcccgggtaaaagagcaagactttgtctcaaaaaaataaaaaataaaataaataaatgaataaataaagagttgttgaatgaatgaaggaacaaatgaattgagaggcaatacagtacagatgggagactatgaatccaagaggttaaatgacttcatcagtcaaaccttgcatttctaatcatgcttggtaacagaaagggaactgtatagagtatttccccttaggaaaggagaggtaagggaggaaaaataaatctgtaatttcagctctgcttaatgaagagtagggcagaggttgacatcagggaacagagtttgaagttacacatgaacatcacttccttctaacgcaaacaaccaataaaaggagaaatctgtgtttattgcctcacctgacctagttctgccctaattttggatgtacagaaccctgataggtctgtcctctcttcacccattcctcaaaacactgacttcagacctatctccatttcacaacaactctactcccacggccctccccatacytttcttgtcctaatcttttcctctcccagaatcaaaatcattcatcttggtcaatggacactaagcatatactgcatgcccagctgtggcataagacaccttaatcttgtgacctggactacataaaggctaagcctatgtactgactaatacgtacaggatggttgcctccctgcccttcaggcaagaacaactgagcaagagaaactgaattgtgatcattaaacacctacatcattcttcccttccagcttcttaacttcctcaaagcttggaattctcaatgagaagctgggcatttacattagccatacaagaaatgccaaaggagttacacttaggcaaacaattatttttgcaagtgattaaaaaaaggaatgcgtaataaagatgggaaaygacacaaactgaaggtctacatcatgtaataacagagtatctaaaatttctgagttatgacattttgagcagtccagtcagtaccgtgactctcaagcttggaattgctagtctacaatttctagccaaatgggtgtcacctcatcactccgtgcctcaggttcttcccctataaaaagagggcagtaggccgagcgcagtggctcacgtctgtaatcctgcactttgggaggccaaggcagttggattgcttgaactcaggagttcgaggccagcctgggcaacatggctagatcccatctctaaaaaaatacagaaatcagccagacacggtggcatgtgcctatagtcccagccactctggaggctgaggtaagaggatcacttgagcccaggaggttgaggctgcagtgagctgtgattgtgccactgacctccagcctgggtgacagagctagaccctgcctcaaaaaaaaagggggaagggggaaaagagagtagtaatcatacctacctcttggagatattgcaaagattaaatgagataatgtatgttaactggttagaacaatgcctggcatgtaaaaatactcaacaaatgagttatttttactatttatgttaattgagaaatagaattgaagtccccttaccaagttgcacttttgaactcagagttcacattttatcacatttcatgaactatataaagggattaaattagttcccagagaaggttgactccaaaagagagagcacaggaagatgatggaatagaaaacaccagatcctccttcccctatggagatgaattaacaatgttagatggcctctgtgagaaatccagaaacyagttaagaggtttctgtaccccaagtatgccaagaagaacctcatgaaagccagcagaaaagttcatggcatatactttccacagcctctccccagcacagcatagcaccattggaaaaaaaaaaaaaatcccaaatcccttctttctkggatgaaaagataaaagtagagcacacattcaatgttctcactttgatggggtggtgggggaggggggaagctacctgagggactggtttcttaactgaatctaagacagaagtgggcaccaggttggaagccactgaaaacaaagatcactgcaactggctgtagcaccagagagtgtgcagtaccactgacagacgctagggagaactccagtaccaaggcttgccacagcaccagagaggaaacagtaccacagatggaaatcgggaagtgaaaatcctgagtacaaataggtaaacctcaactagggtattacatgcatagagaagactcaacccaagaaaaggcttgagagttctccagattatctagtaaagttgactggtgatgatctctccctgtacaaagccagattgtaaggactgggaggggtgctgttttttcaaatactcaagtctcaacaaaagataataaggtatacaaagaaacagggaaacatggcccaatcaaaaccacaagttaaatctccagaaactaaccctaaatasatttatatgaattaccaaagaattcaaaatagccactgtaaggatgctcaatgaactaaaagacaacacagatagaaaactaaagaaatcaggaaaacaatgcataaacaaaatgagaatatcaacaaagaaaaactatgaagagccaattgaaaaattaactagaggggttcaaaagcacttaactaggcagaggacagaaccaccgaactcaaagtcaagacatttgaaattactgagtcagagggataaaacgaaaaaagaataaagaaaggtgaagagaacctcaaagaacttatcgactaccatccagtgaaataacatgtaaataatggacatctcagaatacaaagaaaaagacaaagaggcagagagcctaaaacttctcaactctgaggaaagccatggagacacaaattcaaggttaaaaaaactccaaatagaataaatccagacacgcatactaacacacgtaataaccaaactgccaaaagtcacagacaaaaagagaatcctgaaagcagcaagagaaaggtgactcttcatgtataaggaagctcctataagattatcaaataatttctaagtaggaatcttgcaggccagaagggagtgggatgatatattcaaagtgctgaaaggaaaaaataactgtcaaataagaatactacatgcagcaaaactgtccttcaaaatgaaggaaggagaaatgaagacttttttcccttctttcagataaataaaagctgacactaaacctcccctactagaaatgctaaagggacgtcaagttgaaatgaaaagatgttaaatagcatcatgaaaccatgagaatatacaaaactccctggtaaaggtaaatatgtagacaaatatagaatcctatagtattgtaatgtaggtgagtaaataacttttaaacagtatagaattttaaaaacaaaagataaaaagtaactataagtctgttaatggatatgaaataaaaaaggtaatttgtattatcaataacataacggggtggacagggatgtaaaggagtagagtttttaacgcaacagaaaggaagttgttattagtttgaagtagattgttataactttaagatgttttatgtaattgtaatggtaatcacaagtaaawtatctatagaatacatacaatgggaaatgataagggaatcaaaatatgtcactacaaaaaaaatcaataaaacacaaaagcagcaacaagagaagaaatgagagacaaaaagctacaaggcatacagaaaaactattaacaaaataatagtaaatccttcccaatcagtaattactttaatgtaaatggattaaagtccaattaaaagacatagattggttgaatggatagaaaaccagaatccaactatatgctgtctacaatagatccactgtagatcttaagacacaaataggctgaaagtacaaaaaaaaaaaaaaaaaaaaaaaaaagccaaaaggctgggtgtagtggctcacacctgtaattccaaactggatacaacttaaaagaaactgacaaattcctaaaaatatacaacctaccaagactgaagaaataaaaaaatctgggctgggcacagtggctcacacctgtaatcccaacactttgggaagctgaggcaggcagatcacctgaggtcaggagctcgagaccagcctggccaacatggtgaaactccgtctctactaaaaatacaaaaaaattagtcgggcatggtggcgggcacctgtaatcccagctacttgggaggctgaggcagaagaatcgcttgaacccagaagcagaggctgcagtgagggaagactgcgccattgcactccagcctgggcaacaaggatggaactytaagtcaaaaaaaaaaaaaaaaaaaaaaaagaaagaaagaaacaatctgaaaagacttataattaataaagaaattgaagcagtaatcaaaaacctctcaacaaagaaagatgtcttcactggagaatttttccaaacatttaaataagaattaacatcaatcctcaaactcttccgaagaattgaagatgagggaacactcccaaactcattctattaggtcagcattaatctgataccaaaaccagacaaagacaaaataagaaaactacaaaccaatatctgatgaataccgatgaaggagtccttaacaaaatactaacraactgaattcaacaacacattaaaaggattaaacgaccgggcgcggtggctcacgcctgtaatcctagcactttgggaggccaaggtgggcagatcacgaggtcaggagattgagaccattttggctaacaccgtgaaaccctgtctctactaaaaataaaaaaaaattagccaggcgtggtggcacgtgcctgtagtcccagctactcaggaggctgaggcaggagaatcacttgaacctggcaggcagaggttgcagtgagccgaaatcatgccactgcactccagcctgggtgatagagcaagactccgtctcaaaaaaaaaaaaaaaaaaggattatacgccaccaccaatgcctggaatgcaagaatggctcaacatacaaaaatcaacgcaatacattaacaaatgaaggacaaaaaccatataatcatctcaattaatacaaaaaaatgcatatgacaaaattcaacaccctttcatgataacaaaacaaaacaaaacactcaaaaaactcagaatagaggaaactacctcaacataataaaagccagataggaaaagctcacagttaacatcatactcaatagtgaaaggatgaaagattttcccctaagatcagaagaaataaggcaatgatgtccatttgcatgtatggtcaaataatcttcaacaagggcacaaagagtacacaatgaagaaaagacagacttttcaacaaacagtgttaggaaaactgaatattcatatgccaaagaatgaggttagatccttaccttacaccatacacaaagattaactaaaaatggattaaagacctaaacataacacctataacactcctaaaagaaaacgtggcggaaaagtttcaagacatttgatttgacaatgatgtcctgaatataataccaacagcaaaaatagacaaatgagactaaatcatatttaaaacttctgcacaaaagaaaacaatcaacaaagtgaaaagacaacctacaaagtgggaaaaaatatttgcaaatcacatatatggtaaatgattaatatccagaatatataagggactcctatagctcaacaatgaaaaaaacgacccatttaataaatgagcaagtgacttgaacaggtaattctccaaagaagatatacacacaaccaagaagcatatgaaaagatgttcaacatcagtaattataagagaaaagcaaatcaaaaccacaatgagataccacttcacacccattaggatagcattatcagaagaacagaaaataactgctggcaaggatgcagagaaactggaaccactgtgcacagttggtggaagtgtgaaatggtatagccattttctaaaattaaaaataaaattaccatatgatgcagcaatcactggacacacacacacacacacacacacacacacacacagagttgaccctcaaacaatgcaggggttagggtgcaaactcccaccctcccaccacacagctgaatatttatgtataactttgaatccccaaaatcttaactactaatagcctactgttgactggaagccttactgataacataaacagtcaattaacacatcttttataagttacatgtatgtattatatatactgtattcttaacccttttcccctttgccccaagcatacttgctggcagcgcctgtggttgctgcgtttaccccgagataactttgccacgaaataccttgcttttattattattttcgcattgctctagtatatcaactttggaaacaaaagacatcattctatttatagcattctgtttttagcagtgttatttccatttacaaaatatagtaattctcaatcgctgaaaatgccaaatcctagaaaacaccacattcctatgtgtgatgttaacatcattctcagttgttggccaaagattcatttgatgaatctgatttttctaaaatagacgattctgatgattcagatgattctgatgttactttgtttagaaataactccaagaacagtttttatattttattttcacatagaaaatcaatcagatttgcttcagcctcaaagagtgtgtttatgtaaaattaaatgagcactggcagcragctgtactttttctaaacaggaaaagggttaaattaaaataagctagagaaagaaaatgttattaagaaactcacaagagaaaatatatttactattcactaagtggaaatggataatcataaatgtcttcatccttgtctttgtgttgagaggctgaagaggagggaggggttgatcttgctgcctcagggggtggcagttcatctccaagtttctttcaaattgtcacaaatctccaaaaaatttttccaacatatttactgaaaaaaatctgcatataagcagatcagcatagttcaaacccatgttgttcaagggtcaattatatatatacagctatatatacaattgggtacacacacatacacaccccctctctctctatatatatatccagaaccatttccgggtatgtatccaaagaatgcaaagtaggatcttgaagagatatctgcatactcatgctcactgcagaattattcacaatagccaggagtggaagcaacccaaattccactgacgaatgaatgaatgtttaaaaagtagcatctctctctctmtatatatatagagtataatattttgcagcctttaaaaaagggtatctgatcacatgctacaacatggatgaacctcaaggacattatgctaagtgaaattagccagtcacaaagggacaaatgctatatgatttcactcagtttaagtatttaaagtagtcaaaatcatagaaacggaaagaagaaaggtaggtgccaagggctgtcaggagagggaaagtgggaattagtgtttaatggggtttagagtttcagtttcgcaagatgaaaaagttctagagatctactggacaacaatgtgcatatacttaacgctaatgaactgtacacttaaaaatggttaagacagtgggtttaatgtttttacaataaaaattaaaattaaaaaagagcgaacactggaaataaataacttattgttaagcaagttttctgaacttcgctgataccctagtatatgccagaagatgaatctgagcaaagtaaattgaaaaccttctgaaaatattcaccattctagatgtcattaagaatatttgtgattcagggaggaggtcaaactatcaacattaacaggaatttggaaaaagctgactccagccttcatggatgactctgaccatgttatacaaagcttaagtaagcaaagtgtttaacctagagaagacttgggggaaatgattgccatattttaattcttgggtgttgttttggattatgcagaagttgggtcaacagtagaaatttcagagaagcaaatactagctgagtataagaagaaggaagaaataactagggctagtttagtaattcaataaattgcctcataatccayggactgacttactactacaagtataaaagcaggagctgggtgaacgcctgccacagataacagctatgattacattcattcatttaacagatatttactgagtgccacagtaagctatgtcaggtattagaccagcactgtctattagaactttccacaataatgaaaatggtctataatctgtgctgtccaatatgatagccaccatgtaactgttgatcacttgaaatgtggcactacaatcaggacgaatattatatacaaggtaaaagatgtataaaaaatatgtgagggtgggttccttataacaggaaaacagaagagattaatctggagagtcatgaaagaggttagctcatgcaagactttgcatactctctaggagttatgactttattataaagatatgggaatatcctcaagaaacctaagaagaaaatattaactcagatttgagtactaacaacaaagcacagaggagacattttaagaggtagaaaacaaaagtggaatataattatggtgttttaataacgatgaagacctgacttaaataagtatcacggccctggggagatggggacaaagagaagagatttttaaggaagaagaaatgataaaagacacctggatgtgacaggagggaaccgagacactccatcacacctccaggtttctattttggatcacaaagtgtgtctctctgggaataaaggttctgaaaaaagacaagtctgggaaggaacacagtgagttcagttgttgttgttttaaaacagatttactgaggaacagattttttctttttcataaaattcacccatttaaagtatacaacagtttttaggatattcacagaattgtacaaccattaccataatccaatcttgcgatactgggattatctgcaagagaaatcttgtactcattagcagttactccccattctcaaactgaccctcagccccacaccctccacccacccaagcaatcactaatctacattctgtctctatagatttgcctattctggacatttcatgtaaatggaatcatacaatatgtggtcttttgtgactgcacctgtcattgagtataatatttctgatgttcatccatgttatatcagtatttcattagtttttattgcactgtatggatataccacattttgtttatccattcatcgattcgtgaacatttgggttgtttccactttgaggctatcatgaataatgctatgatcatttgtgtataagttctgtgtagacatatgttctaatttctcttggctatctgcctacgagtggaactgataggtcatagggtaactctatgtctaacattctgaaaaactgacaaaccgttttccaaagcagctgcaccattttacactccccagcaatgtacgagggctccaatatgtgaggtttatccacattcccaatgtgtaagggttatcctcatcctcaccaacatttgttattatcttttttattcaaaccatcctagtgagtatgaaatggtatttcattgtggttttggtttgcctttcctcttgtctaatgatgctaagcaccttttcaagtgcttattggccatttgtttatcttcttcagaaaggtatctattcaaataatttgcccattttaaaatcaggttgtcttggccaggcacggcggctcacacctgtaatcccagcactttgggaggtcgaggtgggcagatcacctgaagtcgggagtttgggactagcctgaccaacatggagaaaccccatctctactaaaaaaatacaaaattagcagggtgtggtggtgcatgcctgtaatcccagcaacttgggaggctgaggcaggagaatcacttgaactcagggggcagagatagtggtgagccaagatcacgccattkcactccagcctgggcagcaagagtgaaactccgtctcaaaaaaaaaaaaaaaaaaaaaaaaaattgggttgtcttttcattgttgaratgtcttagtctattcaagckgctataacaaaaataccagaaactgggtggcttataaacaatatttatttctcacagttctagaagctgagaagtccaagatgaaggcactggcaaattacctatctgatgaaggccttttcctcatagagccttcttgctgcatcctcacatgcwaggaggggcaaacaagcyccctcaaaccccttttatttatttgtttgtttgtttgtttacttgagawagagtctcgctcctgtcacacaggttggagtgcagtggtgcaatctcggctcactgcaacctccacctcccgggttcaagtkattytccttcctcagtctcccaagtagctgggattacaggcgtgtgccaccatgccaggctaagttttgtatttttaatagagacagggttttgccatgttggccaggctggtctcraactcctgacctcagttgatccacctgccttggcctcccaaagtgctaggattacaggcatgagccaccatgcccggcctctaacctcttttataaggacactaatcccatatatgagagttcaaccctcatgacctaatcatattccaaaggccccacctcttaataatataatcttggcggggggtagtatttcaacatatgaattttgggagcacacaaacttttagaccatagcaaaatataagagttctttatatattctagatataaatctcttatcagatatatgatttgcaaatattttctcccattatcaggattgtcttgtcactttattgacggtaccattttcagcagaaacatttttaattttgataaaatccaatttatttatttattggtcatttgtgcttttggtgctatttctaagaaaccattgtctaacataaggtcacacagatttactcttgtattttctcccataagagttctaaagttttagtcttcccactgaagtttacaatctactttaagttgaattttgtatatggtgtgaggtagggtccaatttcattcttttgtatgtgggtactttgtcccagtatttgttgaaaaggctattttcccccattgaattgtctggcactcttgtcaaaaaacaattgctcataaatgtaggggtagtaagtccagttgtagacatgctgaattgcacgtacttatgctctatctccttggaactaggctacatgtgtagaaaaccargtcttcaattcatagtccagaaatctgcacagtgaactcaataaatatttgtgcaattattaccatatgtgcacttcacagtcatgctgcctcatcacccatagccttggacactctgaagcatatcactctgatcttgtgaaggcaccagctggttcccttcctagcgctgctcctctaattgggacactatctgattcagtctgttgcttactgtttgatttttccttaatgatacaaattgaggagagcattttccttcttcccaggaaagaaaatgctcataaacgggaccctgaagctgtcctcttagaaatctcagctggtagaaagaagcagtgccagtggatacatttgattttttttttttttttttttttgagacagagtccactctgtcacccaggctggagtacggtggtgcaatttcagctcaccacaacctccacctcccaggttcaagcgattctcatgcctcaccctcccgagtagctgggactacaggcacatgccaccacgtctggctaatttttatatttttagtagggacagggtttagccatgttggtcaggctggtcttgaactcctgacttcaggtgatccgctcgccttggcctcccaaagtgctgggattacaggcatgagccatcgtgcccagccaatacatttgattttgatctatcagcaaagaggctccaaggtttagtatgtttccattttgtattcagggtttcatttgtgtgctaggtcgaacatctttctgtattcaagccgaagttagagatctaaattgctaaaggacttcagcaggccagagctcagtgaaaggaaggtccacagaagggccactaattagtaatgaatggctaaaagacaagggacttttttttttttttctttctgagatggagcttcgctcttgttgcccaggccagagtgcaatggcgcaatcttggctcaccgcaacctcsacctcctgggttcaagcgattcttctgcctcagcctcccaagtagctgggattacaggcatgcaccaccacacccagctaatcttgtattttaagtagagacggggtttctccatgttggtcatgctggtcacgaactcccgacctcaggtgatccgcccacctgagcctcccaaagtgctgagattacaggcatgagccaccacgcctggccaagaccaaggacttttaaccaagaaaaggcaagacttactgaagtccattgtcttcaagcatctgaaaagccaactggaagaaagaccagttcaaggaagtacaaaggtgaagaaccaaaacagaagataagcccagtcaaaatcctgccagttcccctaggcccatctcaaatgtaataataataataaataaaaattatgtcgttcatacctcttttctgacactgccatctcatatgccccatgctattcttcttggctataaactccttgaggcttatgtaggtctccatagctctctatccctagccccactatcttgcatatagtaggtactcaatatatatatatctgtcaagcaaaaatgtaagcaaatgtgattaaaattaaatgagttaagtctgagaaaccatcagcaccaagaggagcctaaagagatataacaacttaacgttgttatatacaaactaaactaaatgtcctgaatgggatcctggaacagaaaaaggataccgggtaaaaacaacagaaactttaataaatgctggactttaattaataataatgtcagctgggcacagtggcttatgcctgtaataccagcaatttcagaggtccaggtgggtggatcacctgaggtcaggagttcgagaccagcctggccaacatggtgcaactcagtctytactaaaaatacaaaaaaattagccgggtgtggtgacgcacacctgtgattccagctactcgggaggctgagacaggagaatcgcttgaaactgggaggtggaggttgcagtgagccgagatcgcaccactgcactccagcctgggygaccagagcaaaactctgtctcaaatgataataataacatatcagtaataatgtatcatactaatataagatgttaattaacaggagaaactatatgtgtgcaggaggtgtataggaactctctgtacaaccttctcaatttttctataaatctaaaactgttctaaaatacaaagtctattaatttaaaaaagaaagaaaagcattcattcatccttggggatggggctggggtctccattttggaaagacacatacatacatacacatccctccagtgattcctacacatattcaagtttgagaaacatctgggatactaagggttacagtggataacgtccttacaaagaaatcacagaaaaaaatacccatccacacatcaccaaacaaatcatgtcttatggcagcagtaaggacacaacagactaaatcactgacacctcagtaatgcattaagtcattaagcacataataaaatagcttttgcttggatgctagcttctacgatttgggggtggccacctgaaatgctgtccttagaaggatccatgccaaactgggatgaatgccacgatcaactatccatcttaggtacaggtggcagtgtcaatgttttattaaacatctaccaagtgccaagtaccagtgcttggggttctggggttctagcagagatcaaaacaagcataatctctgcctttataaagccttcagtagatcagggaaattttaagtaattacatacatataaacagttacagaagaggaaatatgggatatcacaaaggtaattaacaggaaagggccctcagctaggctaagggtcaaaggctgcctccctgaggaagtratgtttcaaataagatttgaaggctaagaagttagcaaggtaaagaggaaaaggaagcagctagactgagatcaacttgcatgatttagcawcagatcttttcttatttaagaattctttgagagagaagggagaagagaagataagtgcaataaacacagctccacaaaagcagcagagcagcaggcaggacccagagaatggttgagagtgctggaaccttttaaagaagaggcccaggacaaatacatgggaaaaggactggagaagggtgtaggcggctgccaaaaccaagctcttgtaaggtccactgtctctttaagttccataggaaacacacctttagagctataaaatggcatgtctctcctttattacccaaggagaggcacacactggctcatgtttccctttctgtcatgacttccatgaatttcacagctaagtgtgctcgactgaagtaactctttcttaacctaagttttctggtacaattatcgcctctacgtccaaatattatgtctcctgttttatctttcttttgtctatttcatctttcatagagaatgtcactggatctttcttagaaggtgatgcatcaatagcaactgcagtttctaaaccaaaatttatcacatatgaagtcatatagtcatctgacaaaagggcagaatatttgaaaccagaactgtcccatatcctcatggaagataaaccctagaaaataaatacagggtggtgaggctggggtggggtggagtagggcagawaactaacctttactgaatatcataagctgagaacttctcatgtattctcatttgatcctcacaaaaccctctgaagaaagtkaactgtcctcatttatacttgagaaaaacggrggctyataaaggttacgtaaattgctaaaagtcagctgataagtagtacctctggggcagaatccaggtctgactctaaaacccaggctgctcagtatacaggggttaaattaaactaaaacattttaaatctaactcaaattctttttaagaagtccctttacatacctacattaactgcaaactgaagagtagatgtctttcacacagccctaaagacaaagacaatgcatcttcgtatgaatcgctcacagaggaactgggaacagggctccctcccctggtgagcagacagaactacaccatttcaaagtacagtattttttccccccgctctccctcttaaccccatttacttctctctcctgattcctttccaaagtccttcctttggtgcttgtttttgggagaacctccaagttaaacctctaggattaaacttctattcactaactttatcttcttcttctttaaaattaacattctggtagtatatattgatagcctttaaaatgtttataccctttggtcccaaaaataccattaaaatatatattacgaataaattatagtataccatctgacagactattattcagctattttaactgttttcaaagaatatttagctgttttcaaagaatatttagtaagggggaagtgcacatatatcaaatgtacaatgcccaatacaaatatacagtacactttcaattttgtaaaaatgtttcacttgtacctgggaatgataaaggaactacaccacaggtttgatgtggttatctgtaaagagcaggatcaatgcttatstgtattgtcttctttatatcataccattctgttttcatactctccttaactgtttcatgaagggaccggccactcttctcaccctcaccccgacatcagctggaagtgctttcccctgagttaccaccactcttactgcagcacttgcgatacattcatgtggcaactcaagagtcccttcatcaagcttatccagacagacctcgtttcattgggcttcactttattgagcttcacaggtattgcgttttttaccaattgaaggtttgtagcaactgccctgagcaaatctattgacatcattttttccaataccctatgctcactttgctagcatttttaagcaataaggtattttctaatgaaggtatgtacattttctagacatagtgctactgcatacttaacagactatggtatagtgtaaacataacttctatatgcacttggaaacaaaaaaattcatgtgacttgctttcttacaatatttgctttactgctttattgtgcacccactgtatctccagggtaagtctactgcaaggttcctcaaacatgggcagtacacatattctctytaaaggggaaaaatctgtatgtgaaacaatatgatttaatttatattcattcagcttatatatataattgttacttttcttttttttaattttatttttgagacagtttcactctgttgcccaggccggagtgcaatgacatgatctcggctcctgcaacctccccatcccgggttcaagcaattcttctgcctcagcctcccaagtagatgggattacaggcgcccgccaccacgcctggctaatttttgtatttttagtagagatggggtttcaccatgttagccaagctggtctccaactcctgacctcaggtgatcaatccacygcctcaaactcccaaagtgctgggattacaggtgtgagtcaccatgcctggcctattatttttcttaatcaacagaagtgctagccaaaagcctaaaaagcagatgcctacacttttttttttttttgagataggatctcaatatgttgcccaccgccgccggtctcaaacttttggcctcaagccatccttctgctcagcctcccgagtagctgggattacaggcatgtgacaccacacccagcttatatacacaactataaaactaagtttaaatgtcttatgtttatataactagataagcaaaaaacaaacttataaattaaatacaaacaaaatcaccaaaccagcaaaattcaaaataacattaatcaatgatgccgctcaaattaaaatcactgcccacaaggtaaatatggtaatggcataggcctaaaaacaggcagacagaacaagagagcctggaaagatacacacggaatccctatagcccttacaaaagccaccttaggaaatgccccgtacctgcaatttgcagcactgggttcagaaatatatttggacccaactgtgatagctagtataggctaagggtgagaaatggagactgtttgtacctgtgtattttatactgtattctgtaatcacactgcattctgtagaactccaatatcaataaagtgcccttggcccagatgaagcggttcttggctcgtaaccagacctgttgacaggctggactggccatgcctcacatgtacaaggctggccccgggggaggcaggtaactttctgagaattagaggtgattctmactcatgtaggcattaccagccacaaccatgcaccccgggatgttgggatccagatgcctgcacggccgtccaacccagaaaatgttgctgttatctctaccacataaactactgatatgatcaagtatctgaccagcaattttgagaaaaatataatttaagtctccatctcatatttcagaccatttgaagaatgaatttttaaaactgttatacagtcatactcagtatccacaggagactggttccaggacccatctcagataccaaagtttgcagatgttcaaatcccttaggtaaaatggagtcatatttgcatatagcccaggtatatcttcccatataccttaaatcatctctagattacttataacacctaatacaatgcaaatgctatataaatagttgttatactttattgtttaggggataatgacaagaaaaaatatcagtacgtgttcagtatagacacaaccatcctttatttatttatttatttttatttatttatttttgagacggagtctcgctctgttcgcccaggctggagtgcagtggcacgatcttggctcactgcaagctctgcctcccgggttcgcaccattctcctgcctcagcctcccgagtagctgggactacaggcgcctgccaccacgcccggctaattttttgtacttttcgtagagatggggtttcaccatattagccaggatggtgtggatctcctgatctcgtaatccgcccacctcagcttcccaaagtgctgggattacaggcgtgagccaccgcacccagccacaaccatcctttttttaaaaaaaatatttccatccaaggttggttgaacccacagatgcagaatcgacagacacagagggccaacttcacatataactgaaaaaaaaaagtttaataattaaaattctagaaaaacaataacttaaatgtcagaaatatggaaaaatcatcaggaacaaaacttaatgacctaaaatttttttaacttctgtatctaaatctttaaaaaaagcagatagggaaaatgttcacagaagagaatgttcccaatagataaatgactcgaatatataagcagaaatagattgcatattgtgtatatgtgggtgggtttttttgttgttgttttttttttagcaactgcagaaagatttagtaagtttctgtaaatcttttaggtatggggattatttgtgtatgggcggtgagagtgggggatgggagtgtctagttccttacacctccttaccccatctaatccagtaccagacaacagtaagccttcaaaaaacgatttctcaatgaaaatatgaaaatacatagagtctgttagaaaaagagaaacaagaattcaggcagtagtctagaaaataaagaaaaactgagacttagacttcwttatttgaataagtcgattcaatagtacttttttgctaaaataagtggacatgtgcctcgagtgtttagctcacttgttagaatgcatctccagcgttatggcttcctgagatgctccaaaaggaacacagtttggatattacattctagacttttagcaataggtcatatctacgtactctcatgacagtatctatcaagagaaataatacgttactttcattttaaaaatttaggactgaacaaaaaggaaagtgttatcataggtaaaccaaattgcttataaataatcaaatcaaatcaactgacaacaaaggtaatgaaaagtccccctggattcatttaaatccatgtactaaagccaagtacttcaggtacaggtaaatatacacgtataggtattcaactataagcagtctgcaatggagaaccaggttaaactgtagcaattttaaaaatctgtgtaaaaaatgactgacttaaaaaaaagaaaagaaaaatggctcttcattctggaaaaaccacttaagaacttttatttctacatccatgcctttttttttttttgagacagagtctcgctctgtcgcccaggctggagtgcagtggcgcgatctcggctcactgcaagctccgcctcccgggttcgcgccattctcctgcctcagcctccsgagtagctgggactacaggcacccgccaccatgcccggctaattttttgtatttttttttagtagagacggggtttcaccgtgttagccaggatggtctcgatctcctgacctcgtgatccacccgcctcggcctcccaaagtgctgggattacaggcgtgagccaccgcaccctgctgactttttttttttttttttgagacagagtctcgctctgtcacccaagatggagtacaatggcaagatctcagcttactgtaacctctgccttccgagttcaagtgattctcctgcctcagcctcctgagtagctgggattacagtcgcccaccagcacgcctggctaactgttgtatttttagtagagatgggggttttgccatgctggccaggctggtctcaaactcctgacctcaggtgatctgcctgccttggcctcccaaagtgctgacattacaggcatgaaccaccgtgcccagccatccatgacttttttagatcccaaagaatgagatctgagaatgctcttatgctactgtagactcaaaaattaaatgttctggccaggcacggtggctcatgcctataatcccagcactttgggrggccgaggtgggcgaatcacgaggtcaggagtctgagaccagcctggccaacacagggaaaccccgtctctactaaaaatacaaaatattagccgcgcgtagtggcggatgaaaatacgatgtattagccgcacatagtggcggatgtctgtaatcccagctactcgggaggctgaggcaggagaatcacttgaacctgggagatggaggttgcagtgagctgagatcgcaccactgygctccagcccaggcaacagagtgagactccatctaaaaaataaaaataaaaaataaattaaatttctattcaggaggactggttagagcataatttttatcaaataaataaggaaatcaagacaggagaaaggaaccatggaaaggagataaaagtaccygccccccaaatcttttgttttaatgacctgagctaaactgctatttttttcaattaattatttattaagaggagttaaagacttattcttaaagttatcttgattccaaaagcatttcacaaactggcagagataatctaatacaattaggacagaacacaagaaaataggtgtcactgttctctacagcttccataacctggtagcatgaatctccagaattgaatattgactcaaactgttcctgaaaatgcaaaaatcagggacttttactgatagtaactgtggactaatcagaacaakcagaacaatcctccatctaaaaagaactagaaacgctgggaaaaatgtaagaaatacctgcttggaggcacgggggaggaaagcaagtcagagcctgagaaagtgagctcagtgtttgaggctaattttcctgaagggtgtttatcaattctgaagggaatgctaaaagattggcgctggggtggagagtaaaggtgctggtgaagaagagaacattaggaggaaaagtgaacagaacaggtttgtcttcacaagaactgcagctcagcttagagatatttcaatccctgaaactgtactgaaggcaacgccaattstaagtgctcccatgtgccttataacagcagatattaattatctctggaagaaaaaagcatcatcttaggcctcaaattattcctacaaataattttgcaaatatgatgtttaccacacattaaaaaaaacactaggcacataaggagacaagacaatatgaatgaaaatcaacagaaacagacactggaaacaactaacagattgccataattgaacatggactttaagataattacacatactatgttaaaggaggtaaaagacaagactgataattttggcagatagcttggaagtataaaacagaaacaaatagaaatataaaaatcagctgggcacaatggctcatgcctgtaatcctagcactttgggaggctgaggcaggagtatcactggaggccaagagtttgagaccagcctgggcaacacagcaagaccctgtcacttaaataaataaataaataaataaataaataaataaataaataaaagctggccatgggggcgtgtgcctgtagctgcagctacttgggaggctaaggtgggagtttaaggctgtagtgagtcatgactgagccactgcactctagcctgagcaaaggaatgaractctgaaaaataataaaaataaaaaacaaaaaagaaatttaaaaataatttttaaaaaccctgaaattaaaaactcaatgggtggttttaatagcagattatatacagcagaggaggggtgatggagagagacagacagtgagaaggagataaccagaataaagaagagagagagaaacatstaaaatgcagagaaacagttaagagacatagaagatatagtgaaatggaataacatgggggtcctcaacccctggacatgaactagtatcggtccatggcctgtcaggaaccaggccacacagcaggaggtgagtggcagatgagtgagcattactgcctgcagtctgcctcctgtcagatgagctgaagtattagattctcatagaagcgtgaaccctattgtgaactgtgcaygcaagggatccagattgtgcactccttatgagaagctaatccctgatgatctgaggtggaacagttttatctggaaactacccccctaaccccccaaggaaaaattttcttccataaaaccagtccctggtgccaaaaaagttgtgaactgctggtctcacatatatcactgtagccctagaaggaaaggtaagagaaaatggggcagaagaaataactgaagtacttatggctgatgatttccaaaaccaatggaagacatgaagccacaaattcaagaatccctaaaaactctaattataaataaaaagaaatccatactagggacagtatagaaaaattgctgaaaaccaaagacagaactttaaaaacagccagagaaaaagactactttcaaaggaacaagagactgacaagtgacttctcaacagaaactaagtcatagataatgaaatagctttaaaatgctaaaagagttctccaagaaaacaccaaatggcgaatgagaccagtgcagtgggagggcctagaggccccaaaatgggaagccacagcagtggcatccagggctaaggctggggccacggagctggtggtggcaaggccaaggccaaggccaaggccaaggagtaggtccccatcatcaaactgggcagcatagtcaaggacatgaagattaagtccctgaagctctatctcctctccctrcccatcaaggaggctgagatcatcgactttttcctgggggcaaccctcamgaatgagtttaagattatgccagtaaaaatggagacttgcactggccagtggtccagattcaaggcacttgttgccattggggactaaaatatccatgtcggtctgggtgttaaatgctccaagacggtacctactaccatccaaggagtcatcatctttgtcaagctctccactgtcccggtgcagagaggcatctcaggagacaacactggcaagccccacrgcattccttgcaaggtgacagaccactscaactctgtgctggtacabctcatctctacacacagagacaatggtttcatcttgatctctgtgcccaaaaagctgttgatgatggctggcattaaggactgccacacctcagtcaggggctgcactgccaccctgggcaacttcaccaaggccactgttaatgtcatctcaaagacctacagctatctgatccccaagctctggaaggagaccatattcaccaagtctacctattaggaaactaggaattcactgaccagagtctccactgcagagaacccaggctccagctatggctattatacaatgcaggatttttatacaagaaaaataaagtgaattaaatttttaaaatgctaaaagaaatcaatggcaaaccaagagttctataaaactaataaaaagacacttcacaaatggaaaaaagttctaaaattagatgtggtaatggttgtataactgaatattctaaaaaccactaaaccataggctttaaatgggtacattttactgtgtgaattatatctcaataaaacttacaaaaaagaaaacaatgaagaataaataatgatgtttttcgacaaacactaagaatttgttgccagacctgcactaaagaatactgaagagtattcttcaggcagaaagaaaataactccaaagcgaagactggaagatgacaaaggtggtacaacagagttatggggaaaagattatctttttaataaatggtgctgaaaaaaatggtgttaagtaaaaataaaatttaacccctttttcacattatgtcacacaaaaatgaatttctggtgaaccatatatcttaatgtaaaagggaaaacacatgtaagctttctaatattttacaggaaactattttcggtggctcatgcctgtaatcccagcagtttgggaggccaaggcgggttgatcacctgaggtcaggagttcgagacccgcctggccaacatggtgaaaccccgtctctactaaaaatacaaaaatcagccaggtgtggtggtacgtacctgtaatcccagctactcgggaagctgagacagcagaatcgcttgaacccaggaggcagaggttgcagtgagccgagatcgcaccactgcactccagcctgggcaacagagcgagactccgtctcaaaacaaacaaacaaaaacccaagagaaatgtgggcaagatatctgaacaggcactccagaaaactataccaaataaaaataaaaagatgttcagcctcatcagtcaacaggaaactgcagattaaaaccacaatgggatatcatttcataatcaccagaatggttaaaatttaagactgacaataccaagtgttgagaaggaggtgaagcaacaagaactctcacacattttttggtaagaatgtcagctcgtagaaccactttggcaacttggtgtttaccgctaatgctaaagatatgcttatcttttgacctaaaaattctactagatatctacccaatcgaaatgaatgcaccaggagatacacaacaatatccataacagcattattaatagccaacaaagctagaaacaactaaaatgtctagtaacagtagaatgcgtacactgtggtatattcttacaacagaatactatagaccaataaaaatgaacaaataacgattacaacggaatggatctcgaaaacatcttgaaaaacaccagacacaaaagaatactgtattatttcattgtcataaataatacaaaacaggcaaaacgaaactatagttacaaactacagtttttacgagatacgtgttcagaaagcaaaattacaaatggaaaaaaaaaaagtgattaccccaaaaaagtcacgacaggatctggagaggaagggagggtttagcgactgggagagggcaccgggcttctggcagaagcaaggttttatttcttggcctgataatcagcaggctcccgagctgggtgatacatcaacgagcggtacatttgggggccttgcactttactggcgtgcaagaagaaaaaaaaggggggttgagaattaggagacgaaggggttgacgggctccaagtcgaggggaaactacacctgtaaaagcccaaacgcggctctgggcgctggcagggggaggcttcggcaacgcctgggggcttcaggccagcctcctccgggctggaaggcaccgcacaggggcttccgccaacttcggtcctcgcgcggtcgggacacggccacacctgcccgcgggggtctgcctcccaggccgccgcaggccccccggagcctaagaggaccccacaagcagccaaagccagcgccgcctgccccttgcagaacactgccccccacaagccctgcagaccctcccggctctccagacgcccccacggctctcgcgaagccattcccgcgctctgaatgcccccgaatctctgcagagcccccgcggttctctggaagcccccgcgcccgtggagcccccctcccgccctcgggggcaccgcgggcccccagcccagcccctccgacgctggccgctgccacctcccacgaggcgccggccccgactcacctcattgtcgctgccggggacgggcgcgccgggccaggggcgacccggcggcggcggcggcggcggcggcggggcgcgggacgcgggcgctagcgggggagccggccccgggcgcggcggctccgcgtctgactgggctgcggggggcagcgggggctcatcttctccgggtgggcgtcggggccgctagctgcggggaagggccgcggcggcggcgactgacagctgggccccggcccctgccatcttggcgggcgctgcccgggccggcgtgtgcscsggcgcgtgcctgggggccgccgccgggkgatggsggggcggggggcgagcyggctggggtccgggcggcgggaacgcgtgcgcgtccgcctgagactcggggcggcggcccctggcgagtgcgcgggcggctccgagtcctcgagggagaggcgcgcgggcgcgcgggctagtctcagcacagcagccaagagctagggtacgcgcgttgctgttcgccccaccgccctccgaggggactgcgcgcgcgtgcgcccctccgcccgcggccgctgaggtgaatgagcgcgcgcggcggtcaaagcccgacacaaaaggcgcggggccccaccgtccgcgcctccgggagcgctgagcttgaggctgcgaggggcggggcggacgagagtkgcggggctgaggggcggggctttgagggaagcgcgaggggcgtggccggggtgggggcggggcgccgggcgggcacgtggcgcggtgcgctccctcccggcgcggacgctcctccagtccccgcctgaccccagagctcacagaggccaccgggggagccagggtccgtgctcgatggccccatgattcccatcacctggccctgctgagcaccctgcccgctcggactcggggcatccctgatccgagggccgtcgaggtcaccggcgactgattccctctctttgtacataaggagccgtggcggggccggagagttgcagctttggggcgatatcagtattcgaagtatctcccccagctcaacaagagcccacacggstccccagaaccacagcctgtgaaaaatcacatttaccgtacacagcgtcaagtagttcgtccaggttgtctctggtttttaaatccccatctttcctaaaggttagtgaatctcactggtggctggaaaccccagatcctccagggtctcactccccgtgtgtaagaagacacagttccggcccggcgtagtgcctcacgcctgtaatcccagcactttgggaggctgaggcgggtggatcacctgaggtcagaagttcgagaccagcctgaccaacatggtgaaaccctgtctttactaaatacaaaaagttagcccggcgtggtggcacgcacttttaatcccagctacttgggaggctgcagaaggagaatcgcttgaacccaggaggcaggggttgcagcgagccgagatcttgcattccagcctgggagacagagtgagactctgtctcaaaaaaaaaaaaaaaagaagacaaagttcctcatgcattaccagtatgggcactattgcctcccttccccgtgtcacagaacgttaatagctaccttttgaaaaacggtctgaacaagagcatttaaggcgtttgtcagcgtctggcagttaggagggcaatgaagggtcgctattttcctcctgtccaggattgaggagaggctgtgtgtgttaagcagttttgtccaagatatagtaaatggtggagccaagtctcaagcagcgtttttctgactcggaatcccagtgcccatgcgttctagtttgctggggttgaacatcagtgtcatgggctgcagtttgggtctctatgtgcttctctctctccctgtctccttgtacctccctcaccgtgtacaggtatttagagttccctagcgattggttgtagcacctccactttccttcctgtatttgtttaagcccagagttgtcaaacctgaaagggtaccatgatctcctacagccctggtagcagcccctgagggtggtaccctctcataacctcatttgtccctctcttcacaagttcaagagtggtctctttgctacaggagagtcttgttgcatcctaaaatttactaaaatgcacaagcctcaggtcacctggggacattccagctgtgctatggaaaggcaaggttaacccctggtcactgcctatcaaagtcctgtgctgagaccttgggatacaggcctgcttgtttgcagcctggtttattgatgctctttcagcatgtggcccactctgatctccagatcaggtattttccctgctgccctgaagtctgacaagttgttaccgtcttgctcctggagaggttgtttcttgcagctgatgtttgttcatcagagggcttcatgagctgcaggaggagctgagagacgacagattgggaccactcacatcctatcctgtgccctgcttccacctgagtgggcattggtctttgtctgacagaccctgggatgcttggggagtcagaggctccttgtgttaatcctccagctcacacctctctgacctccattcctcctctggcaggtgggaatcctaaagcccatctggcaggtgctgctgaggctcagatgagatgccgatgtccacacaaagtagatcccgagaaaggccttttctgcccttcttcagtaccctccccctcgcctcccctcccctcttccttaacgaaacataatttgaaaccacagtctatttggcacgttttgcattttctgaacaaaggctttattccttaaaagtacatgaattcatgttttccattcttctgataaaaagaaaattaacatttggacatgtggctcccccgaatgacttatttctggaggtcaccagtcctaggatttggaaagtttccttgccagagtcagtgatttcatgacatctgatgtgtgtgggtgcaggacactcagccaggctgacgacccatgcctccaagcgctcctgggctggaatttccatttgtaagggaggcaggaaagatgattttggctgtttgttgggttcaggatagtcacagagtcacagataacagagctagcaagtcttcaaagggcatctcatccaacctacttgtccagagggtgatgaaactgaggccccaggaggtcacacaggtgactggaataagagccaaatgagcatgtatttctgcagactccaaggccttggactgcctgcccagttcttgaagtttttccagccctggggtcactgctgaggagccagctccatggaccatcttctccattgcttagtgtttgccaaaacgaaactcaccacaaataatggaaagaaacacagttgctttcgatgattcaccaatgagaccatgtctggttcacattaaccagcataagtgagttacaaatgcatgccagaatccaaagtaaagcacgcttagacaaccacagatgtctcaggggtttgggggaccacctgtgaccctgtacccctttttcattcacaccattaatttcattgcccaactcagttattaccagcagttgttttccttaaacacagcatggctagttttccttcattcatccattcgtttaatgtgccttgmgctcctcggcacgtgtctgcctcctctcctgccctgctcactgcctcagcctgcctggcaaatcatcttcaatcctgctatgtgtcaggtctctcctggaccgctcagcaccaccctcccccaccacaggctgcaggctccttctctacactgtttcggggtcacacgcctgccctcctgcatcgggattgtcttcttacttgcaggctccccaactaggctgtgaacttcatgagaccagcaagcgagtctcattcctctttgtgctgccagcctctccagccctgtgggcttgtgacagtgcagaattgaaggaatcctgcgtgagcgccgccattccaacccaagcagtgccctgggagggtcagagaccactagcctgtgtgcgcgggcatttttggcaactacggctcctgcttgtgttctatctggcaggaaatagaaattacttctggtccattttggcttccacaccttgaagatggcctgtgggtcaaagctggagcttttttttttttggttctagcaattctggtgcctcagcctcccgccaccatgcccactcagcttaatttttttatttttagcagagatgggggttcgccatgttggccaggctggtcttgaactcctgacctcaggtgatccacccaccttggcctcccacagtgctgcgattacaggtgtgcgccaccgtgcccggcctggagcttattttaatttcacctctctcgggctcccccactcaaaagtgatttccctaagatcatgttttactggctttgaaggcaggaggggtgactctgggatgagggccctatagtcataccggggagcactccagccttctgctggggtgacttagagatctggacccatcaataagaagcgtggccagacggggctgggggaaaatctttgctacctgtcttgtggagggcaacttcttagtgccactgtttgcaaggagaaaggaggacctagtgttaccggtggagggtgtccaggttcttcgcatcttgaacaaagaactggacaaaacacacaaacaaagcaaggaaagaatgaagcaataaaagcagagatttattgacagcagaagtatactccccagggcgggagcgggtgagcatgggggttccagagccccatgacagaattttctggttttcctctcgcaaggccagagtccctccgctagagcgcttcccgcccggcctggcagtcggaatcccgggttccacgcaggaaggggaggggccaggctcctccctgctgcaaaccttgtgaacttcccgaggctccccctcagtgggcaggctggctggagtttctccagggacctgctcccacctggctgtgtcacagggctgggcgggagcaggcctgctgttctgcagccaagtctgagtgttcccactttatgggaacttaatgtctccacttaattgaagaagaaaactaagccaagtacatgcctgggacaaccagccagccatcctagagaggcctaagggtccccctggagcccgtgccccttcccaggagccctgaggccactgggaagggaagccccatccagctcacacctaggaaagccaaaatctctcctcactcccagctagtcatcgggtcccagcttgggggcccgttcaccatcagctttggggaagaaacttcccgctcacttctcctgcctgctgtctcgcaattaccgtggggactgtggcagccaggcctttgtgggagccgccggcacttcattcgcaaggaggccgggaggcccgggcatccgaatgcgagcagacgtgtcaggggtcggggtgttgggaagtttaaaggctgcagcctccccacccagggaggcacggtcttcccgccaggctgcgcagtcagaatgtggcatgtctaaaggagggaatcgtagagaagtgatgaggagagtcaagaagatcttgcctaagagcaattggaaaacaaacaaaaaaatcttgagaatagaaaatacattatttcaaaattaagaaattaattagaggcagtgaaaaacaaaagacactcctgcagaacaagggtcagtacactttctgcaaaggaccagctggtaaatagttttggctttttcaaagccatgtggtctgtcacaactgtggcaggccaattctccctgacaatcacacagacgggcctgtatgacagtcgacagacaggcctgcacagcaccccagttacacagatttccacagcgctgccttaacactgagcaaatagttaaacctagggcaatcggtgcccagacatcaaagctacaaataaagcatacggtcagtagaagccttgcatgggcttctccctaacctggagcaagtcaaaataatagaatctaacattcctagtgccaggacctgcctcgggtcgacaaaatctgagacgagtcaaggtaacagaggcagctgtttgaatagattcatcagagagtctaaggcagcactccagaccaagctgtaaaggagataagatagaaataatcactctggtaccacaggagacaggccttgaaggtactggggcccacacagcttaatcagacttagcttgtttttttttttttatgttccaaatgtgatgggtttattttattttactctgatgcaaaatcaaagattccacaatagcacagagaccaatatattacagagtcatgaaaaaaatggtgtgaacatgcaggacacgaggtacaaactggaggttcagatcgtctcctctaacatgacaccacactgtcgccgaggaacacatttaataacactgcagaactgaaccgaaacgtggcacaaacaggacagcttccaggcatgctttccagcgcctcccctcaggagggactcacaacccctagacttcagtgtggggaggattacaattttttggaagagtaaaaagttcacacttttgaaatttcacagaaggattgtagggccaaaacatggtgggttcatttctcttcacttccagggacaaatctgatgctttcctcaaaccacattaagcttgcagttcaaacgccaagccaaccttgtgacctcctgcactgaagttgtttccatcgattaaagctgataaagggtcaatttgactccgggtcgaagggtctgagtataacccagtccaatcaggctggcattatttactttagcagagagagaagttctacaatccagcttgtacttagtagcaatgccaaaatgggtgttgttactccagccgtccaagcaaggtttattgacatttcaatcccattaaccttctggtagatagaacctccaaattcagtgccatcggtcacatgtgtgtgcagctggaagtctgcagcctcgtaacccagggcgaaattattctgtgacaatttggatttggctgtgtcaaaactcatctgatagccggcaagccacccttcaaagaccaacacagcccagccatagatggttggtccggaaaaatctagatcaacattactgccaacactaaaacaatcccatttataggaggccttcaattccccactcttctttcctgtgtttggtaccaatatggtatcaagactcagtttcaaccctttagccaacttattctccaaagagatttctgtcccaagagtattgtctgtgttccgtttttgagtgaaggtaagtccatagttacagaccttacattcgggttctaggttgcctgatgctttccctgtatcagtgtaagcatgaccagaagtagaaaattccactgcactacaggacttggttttcaggtctatcttccccatgccaaagccatatcctttgttgaagacatcctcagcagcctttcccaggtcacagtaagttggtgtgttacacatatcttagaaaaatctttctcaggttcttatgaaatcaaagacctccacccccaagggcctgtctcccacaagcttttttttgcctctgaccttctagttgaaacaaaattagttaccaatagacttaggcgaatgttgtgctgcacgtaggcacataactccaacctgtataagcaattctaacactttgagttggtctggtggaattatctctggccttctgcctgtatccggttacagcaataaattccctttttttttttttttttgggacggagtctcactctgtcgcccaggctggagtgcagtggtgcaatctctgctcgctgcaagctccgcctccagagttcacgccattctcctgcctcagcctcccaagtagctgggactacaggcacccgccaccacgctaggctaattttttttttttttttttttttttttttgtatttttagtagagacgcggtttcaccatgttagccaggatggtctcgatctcctgacctggtgatccgcccgcctcggcctcccaaagtgctgggattacaggcatgagccaccgcacctggccaattcccttcttcgctagtttgtctgcttctcattattgggactcaagaagaggcagctggacctgacttgcttccgggaacacaactacttcccttggcctttgacttgaagacagccatagaccatatgtgagtggatgtcactgtgttccaagagaactttagtgacaaaaacaggtaaaaccatttttattttcagatgacattatcttacctatagaaattcctaaggaacccactcaaaaactatcagaactaataaacaagttctgcaaggtccaagcatataagataaacatataaacatcaattgtatttcgatagacttgctatgaagaatctgaaaatgaagttaagaaaacaattctatttacatgacatcaaaacaataaaatacttatgaatgaatttaacaaaaaaagtgtaagacttgtacactgaaaactatgaaacgactccgaaagaaattaaagaaaacctataaacggaaagatatccatttatgggttgaaagagctaatattattaaaatggcaagagagcccaaattgacctacagattcgatgcaattcctgtcaaaatcccagctgcttccacttttattttgtgcagaaattagaaagctgatcctaaaattcatctggaaatgcaagggaccatagaatagccagaagagtcttgaaaaagaataagtacaggtatatacattgatggaataaaatagacagtccaggcagggagtggtggctcacacctgtaatcccagcactttgggaggctgaggcaggtggatcacctgaggtcaggagttcgagaccagcctggccaacatggtgaaaccccatctctaccaaaaatacaaaaaattagccgggtgtggtggcatgcgcctgtagtcccagctattcgggagactgagggcgggagaatcgcttgaacccaggaggcggaggttgcagtgagtcaagatcacgccactgcactctagcctgggccacagagcaagactccatctcaaagaaaaaaaaataggatagagagttgagaaataaacccttaactttacagtcaattgattatcaacaggggcgccaagttaaagaacaggctttaataaatggtgttgaaacaactagatacccacatgcaaaagactaaagttgaaaccttatttacatcattcataaactttatctcaaaatggatcacagaccttcatataagagctaaaactataaaactcttagaagaaaacatacatgcaatcttcataaccttgagtttggcggaggctttttagatatgacaccaaaagcagaagtgaccaaagaaaaaataaataaattggaccacattagtattaaacacttttgctgcaaatgataccatctagaaagtgaaaagacaacccacagaatgagagaaaatatttgcaaatatcatatatctgataagatctggttttgtctgtttactgttgctataaaggaatacctgaggctggataaatgtggctcacgactctgctggctggaagactggggacctggtgagagcctcaggctgcttgcattcatggtggaaggtgaaaggagcccacaggtgcaaagatcacagggcgagagagggagcaagagagagggggaggggccaggctccttttgacaacgggctctctctggaactgatggagcaggaaccaactcagtcctcctcccctagggagggcattaacgtattcatggggattcccaacccacgacccaaatacctcccaccgagcccacctccaacgctaggagtcaaatttcaacatgaagtttggggaaacaaacattcaaagtatagcaaagaggtttgtatccggaatatataatgcactctta

SEQ ID NO: 12474 - DNA, 228400 bp, Homo sapiens
gtgatctcttgcagttctcaagtatttttcatcgtgtttagtacaataccataaatcttgaataacgccatgggacctatacaaagtgccactagtgatgctggaagtgctcccaagaagcagagaaaagtcgggacattacaagaaaaagttgaattgcttgatatgtgctgcagattgatgtctgcagctgcagttgcatgctatttcagacagatgattcaccctgtaaacagacaatgtaaacttatggtatcgataaatacagtatagtactgtaaatgtattttctctgttatatgattttcttaataacattttcttttctatagcttattttattgtaagagtacagtatataatacatatgcaaaatatgtgttaatagactatgttatcagtaaggcttctggtcaatagtaggctattagtagttaagtttgtggggagtcaaaagttacatgcaattttcgactgtacagggggttggcgcctctaacccccacattgttcaagggctaactgtataccaaaggctgggcttatactaatagttcaagttacagagataagaaaaaggcatgaacaatcaaaatcacaggggcttgggaaacaaaaaaaacctgattcaaagccagactcagttatttactagctatatgattgtgagcaagttatttaacttctctgaccttagtctcatcagttaaagaggggtaacaatacctacaccataagggttgctgtgtggattacataagatgatatacacacctggcacattgcaggtgctcaataaatgttaatgctgtgccccttatccatttgtagagaatcaatagtaacacaggcaataattatcataccctatgatcaatgctataatgctaaggaagtgtagataatagaggaacttgttttattgagcagagaagaaggaaagggaaaacttcaaacagagaatgagcaggagctggctaggaggatcttccaagggaatagtgtggaccaacacgtggctgtcctggctccaagtcttcctttttgtctacttccagatgaggtggcatctagggcctgaagtgagccatctcttccttctgtgacagatgactgatgttttcatttctttgccatactatataaagtgcctcctctctcaaccagaaatatgaactaatccaatttgcagatgagttaatgctgggacctgaaatgcactgaattctgaagttctgattccaagaagaatgtcaaatgagtctcactctcaatgcatgtgacatatttaaaaaaatatattttaggtggatttgatgctgttaaattgagacatatatataaactgtgaatgatatagttgctgtgggaacccttgaaatctcctaacatttttacatccacaatttcatgatctcaataacttagactcccagaatcccaaaatgttagtaatagaagaccccttagaggcccaacctccacatcttcctgatggaggaatgtaggccaagacatgaagaatgacctgtccaaagctgtacagcaaaatccttaatttctgacaccggaatgcaggcctctaagttggaaacccagctctctttctcctgtagtacagttactcctgagggactgtttagggtaaggtctttttaattgtacacttcagtaacagatattcattttgaggaagattcatttcttttgggtccaattggtgctttcaacaaagtcaaacctcagattcttgaccatctccataatatatatatataagatatttgatatataatatattaagtatatatcatactatatatcaaatatatatcaaacctcaggttcttgaccatctccataatactatgacctaaaggtgacagaatcatagactcttagagtaagaatgagattttagaggcttatctggttcaattcatcttctaccaaagaaatacccttcttgaatgtgtccagtgatgtattcatttccccaagagtattatcccattgtttgcccatgaatgctagcatcatcaagtagaactctgtttctctgtctactctgtccattaagagaaagggaaggaagggaatggtgttcacttactgagcaccgtttgtgtaccagacacatgtgagagtcttggatatgttacctcacttgattcctgaaacatccctataaagtagatgttcaatttacaaactaaaaaaaaaaaatagttcagaaagtttaaataatgtgcccaaatttacccatggtcagtggaagagtcaagtccatggactctctttggtatgctgagaggccttgtcttccctgcctcctatctctcttcagtgtagctctttcagcaagctgtgctagagatttccttttaaaataaaaatctgcttaaaggcctttgatggctcttcaatacccactcaaggtaaatagttcaatacccactcaaggtaaatagtccaagctctttagctaataatcaaggcccttgacaatctggctccagtcaaatattgcaggctcacttccctcttcttttccgatgcatcctaggttttccatgaggatgcctttttgtctttgttcatgctgtacttgctgcctatgtgtccttcccctccttctctgcctaaaaaagtcctagttttcctttaaggtccactcaaatgtcaccttcttggtgaagtcttccccagtatctctgggctcaatgaaccctcctctgccttctccatattacagaggacattgcaaagtcctctgtaatagccttttttgcattgtcatggtcccttgtagactgagatccttaaagacacggattgtactttacatttatttgcattcccagttcctggcacataataggagttccatagatatgtgtggaatagaattgaggcctaatccttttccacatgttagcccttcaattatctgaagacccttctaaggccttgccctaccccactctactcccattagtagttatttcttctgcaggctaaatgttcccaactcctttcagctgctccttataaagtctgatttccagattccttatctggtcatttgcttctgggtcataatttgtcaacatcactcttttaaaatataatgcctaggacaaactcaatagcccaaagtctggccatagcagaacaaagtgaggggattccaaactgtgattccaatctatgacgttttcttggccattactgtgtgccaggaggtctttctactttattttctttcagtcttcaataatctggtgaggtaggtgtcatttcttccattttatagatgaggatataagccatctggtaaggcactttgagaataagttaaagtcacaattccagagcataaagcaaacttgtgatcaactgatacctttagatcattcgtacatcaactgctgtaaagttattattttttccagttaccggctagtgacaggcttaagggaaactgaggacaaagaatcagtacctttagaagggtgtgaaaccaaagcatacagaaaaggcaggttggattaatgaccaccttcctaacaataacagcctttatctaggagctcagagactggaatgtcttaaccacacagcttcctggaactatttttactttgtattttacaagaggagaaagagcagaagcgtcttagataaacaacaaggtttgggctcagcacatgtctgaatctgaacagccagtggggccctgtggtcacaaggcagataataaggaggttgcctctttggtctgtggcttgggtctgaaagggtcctactgtgcacattcattctataaatatagactgatcaccaaatgtgttccaggtatggtgcgaggtgctgtggatgtaatgaagaacaaagacagagttccaatctgtggagcttacagtcaggtgaaagataagcataaatgaaaatgatatgcacagatcctagtaaatgcaatgatgaatgaaggtgccaggctacaaggagagcgaaaggaggggcatttaatttatcctggggtgaggatggaagagaaggtatcagaggaagttcctggggaaggtagtcttaattgatgtgtaggacttaatgtggtgaaggctcttatgtatttcaatgcatcccccccacaccccgcaacacacatactttctttaagcatcagaaaccatctttcccatttcctttaccaactcttctactgggtcatcaacaacatgaaaaaaaacaaaaacaaaaaacaaaacaaaaactactgtttttgtcagttctgtcagtgccagaataatcactcctttttgctgtaatgtaatgtagaaaagagcagacctggggtttcctagcatacctcctttaaaaaaaaattacatcctgattaacttgcctatttcttccctctccattgcctctgtatttcttggcttccccacacctgtaacccaaaggtcacagggtctgtcatagcccaattccactctccagttgcctcttggtttttaaccccccttattaaaatccaaacattaagcaactaataacacccatgtgtaattagttgtttaattgaacagcacagaactgttaatacattatgctgtgccctggaatattaagtggaataaaagcaaagtactatattcaaggaaactacagtctgacttaaaatactacaatgggaaacatttcacacagagatttttaccaagtgacagtggagaggagggagaaatgagttcttcctgagaagtgtcagagaagttctgagctggatctaaaaaagaagcaggaggctgggtgtggtggctcacgcctgtaatcccagcactttgggaggccaaggagggcggatcacaaggtcaggagattgagaccatcctggctaacatggtgaaacgctgtctctactaaaaatacaaaaaattagctgggcgtggtggcaggcgcctgtagtcccacctactcaggaggctgaggcaggagaatggcgtgaacccggaagatggagcttgcagtgagccgagatcatgccactgcactccaaactggatgacagagcgagactccatctcaaaaaaaaaaaaaagcaggaatccaaaggacaatatgcataatatttatttatttttagcagatgtgggaatatctccctcatgccaagccttatctaaggctacaggtgtgaataaggttcctgatctcaagacgctttcagcctagaaaagaggtttagaaatatactccaataatggcaacatatatggtgccatggacagagttacagaacaaactgctaggggaattcatagagaaaatgttcaagagaacatttctcactggacgtagtaggcagaattctaaggtagcttcctagattaaccttcatgtacaccttctgcatagtccctgggacagtggctatgatgaattttactcctgtgattagggtatgtgatgtggcacaggtgatcttaaagtaggaagattatctaggtgggtctgacctaattacaagtcttttaaaagctcatagtgttctctgactggttgaagaagggaaatcagagatatttaaagaatgagagggagtgacatgagaaaggttctctgttgatgagataaaagggatcacgtggcaaggacctgagagtggtccccaacagagagctggcaaaacagtgtagctgtgggatcctagtcctacagggacatgaattctgccaacagcccgaaggagcctggggcagacctttccctcgtggaggtgctagacatcttgatttcagcctatgacaccacgagcagaaaacccagccacaccatgccagttttccgacctacacaactgtgagtaaatcaatgggtgttgctttaagctgcaaaatttgtgccaatttgttatgcaggaatagaaaactaatatgagcacttacaacactgtgctctcattagctattgacataatagtttccccaaatatgggctccttagatttaggctctaattatccttgtaacctcagggctcttcatgagacaggtactccccaaaacgccatggaatgaaagtttaaattagacaacagggatgcagatcagaacctggatagattctgaccatttccatttctcaagaatgggcagacggatactgacaccaataccaggatacaaggaggcggccccccttcagtccaaagctctaagacctattctagaggcaaggcaagtaatccaggctcagctgccccatctgctgctccagccttgcttaagtggacttccctccaaggaacattgttcacagaaggatcattaacaagacattcctgtgtgacctgaggattgccatgttctaaatgatgcccacacccactccacatccagctcagcagaggtctcgggatttatattgcactgtattttcaagcagccaaaacagaagtcaagacgtcagtttcctaagctgctaaaatgatgtggtggttaaaccaattgtgtgccaggcgcagtggctcacgcctgtagtcccagcgctttgggaggctgacgcaggaggatcacttgagcccagtaatttgaggttacagtgagctatgatggcgccactgcactccgaccttggggacaaagtgaggctccatctctaacaaaacaaaaatagaattgtgtagccaacatggctggtgggcctggaagaatgagcctgtgcattgtacctggcccatcacgggctcagtgcgtactcgttgaagggatcaccacagggaggaccgaggacgctgacactccctagggcatccaagcaccaactcatctctcacctaccctccgggtgcagtgctatcgtgttggagaagaggcccctgggtggctgtgcgaagtaactcgcccaaggtcaccacacggccagccactagcccggcgggagtcgcccgaggcgaggcccacgtcagccggtcttgggggcccgaccggtggctcctccaccagccccacgcggcctcagagcgggctactggcgtcctcgagattcgaacccgagtcctcggcctcgtccccgccctcgcgccctctcaggcctcagttttcccatctacaggacgcagaccggagagctggtccgggcgccaactgggcccccggacccgggtcggcaggccggcggggtacggccgggccgggttcccgcgcgccctccctcctccagcgcgccgccccgccccccgcgcgagcccaacggccgaggcgcgcgccacctcgcagcgggaggcgcgggggaggggccgggggagcccccgccccgccccccgcctcagccgccaccgccagctcggtggagccccccgccgcccgcccgccgctctcccgagccgcccgcccgcccccttcccgcgtctccgctccctccctgcgcagcggaaacatggcggcgggaagagagtgagccgccccgcgcccccgccgcgccctcaggtaagcgcctcgcggccgcctccgcccgcctaagagctcgtgccctgaggggccgcctggggccagaaggcggtggcgggacctgcgcagccgctgcgcctgctcccccgggccggggtcagcctgtccgtctgtctggccggcctgccagtctgtggtccgcgcggggctgggccctttctcggccgtgtcagcccggccccgagcccggaggccggctctgcatctgcggtcgggcgggcggggcccacggtccggtcgcggccctgacgccgccaggactgcccgggggccccggcacgggaaacccaaggccgggggccctttggagggtcggcgtgggggcggtccgtataggtcgccgtgtctggccggcggggccgggtgggccggggcaggctggctgggggccgagggccgggcggcggcgcgaccccgtctgcgcgggtcagtcggtcccctccggcgccagaggtgggaatgcctgtgattctggctggccgggtcccggttcggggaaggcagagacagaggtcgacggggcggcgtggcccccaccgagagctggggcgcctagggcccggagctgtcagcagcgtcctgggggctgggccccggcyggccgactcacgtgtgccgcctgccccagtgccccgccggaaacgggcagggagagcggccccgcaccgaagtgagccacagcggccctgggggccagacacgtgggcacagttgtgtgccagcccgagagcatcgaaagtggtatccagccgatgggtgaaccccggaatatctcctgactggaagagaatttaaaagtcatctaggggcgctttctcccatcccatgccaaagtgactttgaaaatccccaaatccccccgataatttgacgagcccgtttggaacctcttccagtgatccgaagcgaatctctttaaaggaaacccattctgttcctggacacatttggttataagttgaaagaaacagctggctcccatccttcctagttcttttcccttatgggaagctgttaagatatctgaagatagtaatcatgtcccctgagtcttcacttccactttcttcagttgtctctcatctgctgtggttctctaaactgtcctctggatgagctttagtttcccccatccccttaaaggagagtttcttaaaagtgatcctggagacaaaacgtagtaagtttctctaagaaacagccccaaggattgacctgcttaaatcaaaagtactctagattcccttcctcatttctgtactgtattttgaacttaaaaaaaaaaaaaaaagaaaacatttagtagtgtttgttcaaacaaactaaaagacatcttattttgtggaaatttgggggtttccttccttttaaaaaatgtctataaacactttatcaaatgttgctaactaatgtacatcaaaatgttttgttgaagtgtaatgtgccaggcaaatagaatagctctttttttttttttaaactctgaaaaggattgagacctagtttagtgccaaactgcaattttaatatttggttgcagagggaaatgctttattacattgaactctttgctctagttctaactgccagcaggaggcccaaaattactatgaaagagaacactttttgttgcttacttaccaacctcctaaactcttgcctaagcaactctgcaggttagtaatgttttaagcccagtagagatgagatggccttgtagataaaaggccaggctcttacatctgggatcctgtttaagtactaagcaaagtttcagtgtttttacaacttagacaagcacataccagcagtcagaattggttctttatttttgttcttaagccttcattttttaaattggtcaatagttttgaactttgtagcacatatgtcaagttttgattttaggtatgtttgtgcaaatgttgttcccttttatgtaagttgggtaaacatttgcatagcaccattctcaatggaactatacagatccagaggaaaggccctgattccttccttgcaaaggacttggagtgaaaggtagaggatacttaactatgagaaagaattgatgtgaatatcccactgaaaatttaaacttagggctggatgcaggggctcatgcctataatcccagcactttgggaagctgaggcaggcaactctttgaggccaggagttctggaccagcctgggctacgtagcaagaccctgtctctacaaaaaataaaaataaaaatatagctgggcatgatggtgtatgtctgtagtctcagctactcaggaggctgaggcaggaggaccgtttgagtcaaggagtttgaggcttcagtgagccatgatcacgccatagcaagtgacagaatgagaccccatcttttaaaaaagaaaagaaaattggtatgttctaaccttcactgtacacttatgtacctactatgggtcaagcactatgctatgtactgtgctcagctgggtttacaaagatttccaatcttgtggagctggtaaattagatgcttaaatagattatctcagaataaaagatgagaactacgcatagctgagatatacaaggtgagagtaaaggttgcccaaaggtgagggcacttagactagcctaggagttaaaggaaggctttgggaagagatgatatctgacccaaatcttaaatggtaggtaggagtaagtgaggcaaacatgagcagaaagcgtccttcaaacagagaaaacagcttgagcaaaggcatcaatgtgagaaaaggaatggcttgcgtagagaaccacaaacagtttgggactgctaggaatataacaataagtgatgagttgtaaggctggaaatacagtcagaggccatgtcgtggtggaccttgtatgcataagtatcctaaaatcaattcagtaggtgttttttttttatttttatttaatcactggaaggtgtctatcagacatggttgaagtaacatttttaaaatgtggtcatagggatgaagagaaagaaatgaatctgagaaaatgtataaggctttaatgattgattgtatgtgcaggtgagagggtgaggagtcccgtgtgatgctcaggtttttgccttggatgactaaggaggatatgttggtaattttaactgagacaggaaacgatgatgagttcaattctggacttgaagattttcaatttcttgagttagatcagtgagcaaatatagtggaagtaagctgagaaaaaaaagaggtgtggtcagaaagtggaatatcggagttaagttgtctgatattgggactgttctaggtgacagcgaggtctctgtgtatgggtagctaaaatacagcagaggcgaaggtcagtaaagctgagtatgacaaggaatttggaggctagtgtattgaatgagtcatctgtgtagagagtgaagtgattgaggatgatgggatgtggggaagagagaaagatgtgacccaggtgcagtaaagataggggattaatcaggagggtggtagatgacagatgaggaggtggggtagagagttatatagccagatggtgcaaaccttgaaggaggaggggtttttaaacacaagagtgagaaggtaatagtttttttacttttccttcctggaagcagagttctgatctctatctttattcaggactcatattaatcattctgtttgctctgaagagtctgttcttagtcttggaaagtgggagggcacatacctcatattgaatcctttctgctaatacttaatgacaaagggcagtggaggttttttcctctgatgatcattagtgggtgggtagggaacaatcagataaagcagtgaggatatacccatggttttctagacagagtatagtggaaagagcctaggctttggagttagaaacaccaaaattcagatctagactctgtcacttactagctttatgactgtaaacaaattatttagcctctgtgagcttcagtgtccttatctgtaaaaaatttatacttcataggatatcacaaatattacatgaaaaaatatatacacacataccacataaaatcacaagcgattggtgattcatagatacaaagtaaatattagttcctttcttccttcatttaaggggcttatgctctgctagctgaaatgaaccttttacatgcttacctaagttataaaatagaacatagtgagtactctaagggaggtagtagcaaagtggtaaagcagttcagaggagggagctgtcatttctaagcatttggaaacaaggttgggcttcatttcaaaatgaattttacttgggccatgaacaaatttcaatagagtaaataatttaggtagatatataaaatagggaaagcatagggtatggtatctttgttaaaaatagctaccacaggtttgagtattgtatttgtaaaagctaatagtaggaaatatggctagagagatgggctggggcattggtattaaagatccgaaactgtgatgcagtttggagttgattctggatacattagggagccacacattggatgtcttctttctctacctcagtttactatctgtaaaatgtataggcatcaattcagaaacttcaaatttttgtttgcaataaacgaaataagaaattccacacttgaaaagaagttcctgtgtaggccaattttaggttaaaaaaatctaagatttgttttgtagttgtaggttaatctttgcagtaatcttatttgattgataggcttcgtgaggttaagaaacatacaagatctcactggtagaaagtgaccgaagaagctctaatttcaaattctgtcttttttattccgccatactgattaggattttaaaggaaacctgagttcctcaatgtcactaaaaattaaccgcacaacccctggcagatcacttttactttgtcatttataaaatgaaggaagatgtagctgtaaggtttaactaagataaagtgcaaagtactttagataatgttggtcacatatcaggcactcaaatgttgggtctttctctccccatctgtgaatgagggaatttaaccacagcattccaagaccttagtgttaactctctagccaccgtaaactgctagaactaattacatttggccttctgtatccatgggttctgcatctgtgtattcaaccaattatggattgaaaatatggaaaaaggatggttgcatctgtactgaacatgtacagacttttttcttgtcattattccctaaacaatagtataacaactatttacatagcacttgtattgtgttaggttttataatctagagatgttaaaatacataggaggatgtgtgtagatcatatgcaaatatgattttatgtagggatccgatcatccctggaatttggtatccaaagggcagaggggggccctgaaaccttttgataaccttatcgccagataaacccagcaagacttatcacctgttatctttgtcccagaatcaaacggtctgtcttccatactgttattcttattttgacctggcttccttttactctcttccagccctgcttttttgctccttccacttgctctctcaaactcctgtttcctacattgttaaccattttattggatgtctttttgtgtgtcctggccttaagtggaagccaggctatctcctgagtcatggagaacatactacttcctctgtagctcttttaaatggatgcagcacattctcctgcacccctcccatcccaaagaagagaggtgaarataactgtatttttttattctccactatatctggaccattacttcttcatcttcttaaaacccctgtgctctttggctatacacacccttggtttctgatataatatattcttatacaatatctattaagatgaaaatacacataaactacaatctagcaattccactcctaggtatataccctttggaaactctcyaatgtatgcataaagggatgttcaaaaatattcatgcaacactgctacagcaaaaaatttgaactagtctaaatgcctgtcagtaaaagaatgaaaatattgtggtatatttacttaatagaattccatacaatagtgaaatgagtgatctagatctatatagtaacatgagcaaatctcacaaataacaggttgaatgaaaaaggtgaattgcagaacacatttatataaagcttgacatgcacgtattatttagggaggcatacttatgtaataaagaaatacatgataattataaataccaaattaaggatagtaggtatctccaaagggtaagctggggagaaaagaccaagaataatgcaaagaagggcacacacagagcttaaattgaataagtaaatatttttcaactgagttgtggatatataggtatctattaattattctttatgccttttatatatctgaacttttctttttttttttttttttttttttttttagacggagtctcattctgactcccaggctggagtgcagtggtgcgatctcggctcactgcaacctgcacttcctgggttcaagcgattctcctgcctcagccttctgagtagctgggattacagacatgcaccaccacgcctggctaaattttgtatttttagtagagacggggtttcaccatgttggtcaggctggtttcaaactcctgactatgtgatctgcctcggcctcccaaatatatgtatatttttaaagaataaatagcattccactcttgttatgagcataatacagggagggaggggacagcagaagtataaagaaatactaatattagggtgaatcataaaattttttactcaccactaatattagagtgaaccataaaatttctgtttttgtaggtctgaaatgatttaatataggcagattcaagtggcctattcaatctaatgtaactaatgttctggttgaaatatattcaaaatgcattgggcatggtaactcacacctgtaagtccagcactttgggaagccaaggtggtcaaatctcytgagcccaggagtttgagaccagcctgggcaacttggtgaaaccctgtatctgcaaaaaatacaaaaataagcttggcgtggtggaaacatattcaaagtactatgggaacactagggcaggaacaactgatggccaaggcagaaggagggaagtgacatttggaaaggttccagagagagagaatgacttttgaactgaatcttttttattgtttaagtttttttaagasacagagttttgccgggcgcggtggctcatgcctgtaatcccagcattttgggaggccgaggtgggctgatcatgaggtcaggagatcgagaccatcctggttaacacggtgaaaccccgtctytactaaaaatacaaaaaattagccaggtgtggtggcgggtgcctgtagtcccagcaactccggagtctgaggcaggagaatggcttgaacgtgggaggmgggaggcggagcttgcagtgagccgagattgtgccactgcactccagcctggatgacagagccagactgtgtctcaaaaaaaaaaaaaaaaaaaaaaaaaaaaaaaagaggcagagttgctccgttgcccagcctggagtgcagtattgtgatcatagctaaagtaatcctcctgcctcaaccttccaagtagctaggattacaggtgtgtgctcatgcccagataatttttaaaacttgtcaaaattgggaatgattgtatgtggaattattttaaagagcagaaagaaaaaaaacaggggtcttgctatgttgtcaggctgttstcaaactcctagtctgaagtaatcctcccacctcggccttccaaagtgytgaaattacaggcgtgagccatcatgcctggccctaaactgaatcttaaagattgagaaggaattcaccagatagagggtgaggagatgaaagaagcccttccagataggaagaggtaaagacccctttcagtgggtggaatctgccaggtggaatatgtggaggttaaagaaacacagcagaggaagagactaaggaacaataacaacacatacctttatagtacttactaaacaagcacaaagttaagtaacctgtgaaagatcacagggatagcaagtggtagagcctggatttggactctggcagtctggatctacagtctgtgctcttgtgcagtaagttatattctgaatcactataccataagcataatcaggagaaagtgatgtttggatgccaagagaacaacggtaagtttcaaaaagaaaggaatagtcagcagtgtgaaaggccctaaagacatgaaatgggaatcctaaaaagagaagatcattggatatttttttaaaaatcattttgctgtaagttacagtaaggaataccgggatgatagagatatggatatctcagaatactagtgattcagtctatcagttctgtgggccagtgattataatttcatttaattatgaagaagatataatcagggactattaaaaatagatcatctccatatttaagtacttgatatattaacatgatcgaaagacttttgatcttctgctatctatagtcatagttactcttaggtaactatgattgatagtgacaattttgtttattcttctgtactttctggttttgataaagataaaacttagcttgctagtttagtggatttttcagaatgggatgatattctaaagaacagtagtagttcaatcccaaatatttcatagacaagaaggtgaaagagaccttataagctgcatggtatgtggaaagagttatatggcttatatatatatggcttatatatatatggcttatatatrgggattaagagtcctgattcaagtcccagtttgccactcagtggttctgtgatttaggcaaggagttgccgtgaatgatttctaagatctcttctcactctcaagttctgtaactattaggtcatttattcagtaaagaaactgaggcctaaagaagggacttgtttgtcgagggtcaaaaactggaatctggttctcttgactcttggtcctggatatctgatggaagaatcatcaaacatttgaggggctgccacatagcagacatgtattaggtgctcgaaaaagcaaaaggcatgtgaaattgtttcagaattcatttatccaatttgtgaaagtaacaatcagcatcttctgtgtttgtttgtttatacatatgttgccttattccaaaatgtatttaaagcagacctactctatataatgtactgtactaaaaaagggaataaccttttttgagtatctgtcaaatatgttgaaacgtataaacacgttatttttacccacctgcatataggtagtatcacctctattttatacataaagaaactgagactcagagatagctggccaagattatgcagtttataagtaataggacttrgtttcaagcccagaccagcctgacttcaaccccagtcctcttttcatttcaccatatatgtgccccacagcagtgttatgtaattctgagactttatcagtacaggaggcaaagtttacttgcaggaattgacacatatatttttagtctgaatatatcttctatctcaccaaacaatgtcrgcaaacaaaagatccctggttagaagaatgaaatggtttagcaaatcaaagtcatatttattttttaatttgagcagatatatgactagattcctcgttaggatcagtgctcatattttaataaattataacatttctgtaccccttcaacctttggtttgcagtttttcaacctttaccagctacatactaaggataaaaaggtgagaataagatagggtttcttccctcagtgggttttactatttaggtgacagatataataactttacctaagatctcttcctccccaaaagccataacctgagtctaatcatgagaaaacatcagataatcccaactgaggtacattttataaaatttcttttttttttttttttgagacagtcttgcactgtcaccctggctggtgtgcggtgtgtgagatcttggctcgctgtaacctccacctccctgggttcaagcgattctcctgcctcagcctcctgagtagctaggattacaggtgcctaccaccacacccggctaattttttgtatttttaatagagaccgagtttcgctatgttggccgggctgttctcgaactcctgacctcgtgatctgcccgcctctgcctcccaaagtgctgggattacaggcgtgagccaccacacctggcctataaaatttctaatactccacaaaactgttaaagtcatcaaacaaggaacgtttgagaaagtgtcagccaagaagaggctaagaagacataatgactaaatataatgtagcatggtatactggatggggtcctgtcatagaaaagtaatctcaggtaaaaattagggaagtctgaataaagtgtggactttagttaataaggtatcaatattggttcatgaattgtaacaaatatgccatactaatgtaaaatgttagtagtaggggaaatagtacagggtatatgggagctatctgcagtttttctgtaaatctaaaactgttctaatagaaaaagtttatttttaaaaagttataataaaattattctaattttagatgttatttctttgagatttaattaaaacatatttcttcataaaatgatgtgcctaatttagttgactcatttgataatgactgacaaactgcagtttgttgatagatgcatgtgccagaatgtatactaggtggatgtcatatgaactttttctgcctcagtttcttatgtatatagtgtcaaaaacatgccaagtcctagtaatagtgaatcccagtacaaaatagaccacagtttgatcagctgtctcatagcatattataaagacggccaacctcttaacatggtatatagaattctactgttctgttctcaactttgatccagtcaattctgtgttttagggactatcatttgtgccactcccacaaaccaatttctaatcatatggggttctttaatttgcaagcaataataatctactctggttaacttcgtttgtagcagcaagtcccaaaccttgttgaatatcagaatcgcctggagaaatttttaaaattaaaagtaccatgtgccaaaaaaattatattgaattgggatctctaaggggatagaacataggaattaatattttctaaaagctctctaagtaagtctgatacttactcattgttgccagtttcagtgaacagccccctaattcatctatttgttcaggcctaaaatctgagaatcatttctttaattttttttttttttttaagacatagggtcttgctttgttgctcaggctggagtgcagtgatgcgatcatagctcactgctgccttgaattcctgggctcaggggatcctcttccctcagccttctgagtaggtaagacctcaggcgtgtgctatggaacccagctaatttttaaatttttattttatagggataaagtcttgccatcttgcccaagctagtcttgaactcctgggctccagtgatcctcccgcctcagcctcctgaagtgctgggatggtgcctggctgggaatcatttgttaaattatcttttctccatttttagttcattgctgataccccttaggactacatcctaaatatctaaagaatctttctacccctccctcaccacttccttcattctagtctaagccaccatagttcttcttttggaccattatatcaaccccctatatggctttcgtgtgtctacttttgtaccctatcctccaccaatgcggtcaccacagatcagatcatatctctgcctaaaatccttcagtggctttccattgcattggatatacaaatgatattttcccttgtggtctacatgatatggagactaccttcttagcctcacatagtgccaccatcccctagctaagttctagttacattggctcccatttcatttcttgaagatgtgaagctctttcctgtctctcagacttggcacatactgtttcatctgcctgggagagtcttcccctgactcttgattcattcttaaacattacctcctcatagaggccatactgactgcccttccacagtcactctgttaattctgttatagcacttaatcacaacatgtaattatttatttgcttacttgttaagttccatgaggacatgagggcaggggtcttgccaatcttattttttttttaattatactttaatttctagggtacatgtgcacaatgtgcaggtttgttacataggtatacatgtgccatgttggtttgctgcacctattaacttgtcatttacattargtatttctcctaatgctatccctcccccagccctctaccctccgacaggccctggtgtgtgctgttcccctccctgtgtccaagtgttctcattgttcacttcccacctgtgagtgagaacatgcagtgtttggttttctgtccttgtgatagtttgctcagaatgatggtttccagcttcatccatgtccctacaaagggcatgaactcatcctttttcatggctacatagtattccatggtgtrtatgtgccacattttcttaatctagtctatcattgatggacatttgggttggttccaagtctttgctattgtgaatagtgccgcattgccaatcttattcttatatgtgactcctatcacagtgcatggcatataatgcattcattaaaaagttaaatgaattaatgaatcttttttttttttggtagggggttggagttttgctcttgttgcctaggctggagtgcaatggcacaatcttggctcactgcaacctccaccccctgggtttaagcgattctcctgcctcagcctcccaagtagctgggattacaggcatgtgccatcatgcctggctagtttttgtctttttagtagagatacggtttcaccgtgttggtcaggctggtttcgaactcctgacctcaggtgatccacccaccttggcctccgaatgaatgaatcttaactgccaccaacctggtccaagcttctgtcatctctcttctgaattactgcagttgcatctgaacactttgcctacaactgctctgggtcccctttaatcatcttccacgttgctttcagggttaaatatttaaaattttaagtctgataattatactattctctctacattcctttctttttttttttccccaagtcaggatcttgctctgtcacccaggttgagtgcagtgatgtgatcacggctcactgcagcctcctaagtacctggaaccacaggtgcgcaccatcacacccagctaatttttttttttattttgtagaaatggggtctcaccatgttgccagggctggtcttgaactcctaggcttaagtgatgctcccacctcagcctcccaaactgctgggattacaggcgtgagccactgtgcttggctccttacattgtttatatgcttcctgctggtcttaatgtagcttatagaatgttttctttaattattttttaattgtggtaaaatatatgtaacataaaatttgccatttcaactatttttaacagtactaagtatagtcacattgctgcgcaaccmtcatcaccatccatctccagaacttgtttcattttgttaaactgaaactctatccattaaacaataattatacatcccattgtggagtcccaataagtaagcagcaaagaggaaggagccacaggtaggggagaacaatgaacaattgttctgagagacggctaattacaaacaaccactggcacaactaccttgtcctcatagccccctccagcatgaccctgtaaaacttccctccagtccttgcctctttgtagacagccctttctctgctgtgctgcctattgcacctttgcaacatattttcatactttctctaataaatctgcctccttttgttttgtttttgttttgtttttgagacagagtcttgcactgtcgaccaggcaggagtgcaatggtgcaatctcagctcaccagctcactgcaacctccacctccagggttcacatgattctcctccctcagcctcccaagtagctgggattacaggtgcacaccaccatgcctggcgaattttttgtatttttagtagagacggggtttcactatgttggccagactggtcttgacctgacctcatgatctgcccgcctcggcttcccaaagtgctaggattacagacgtgagccactgcgcccagccaaatctgcctttctttacctataactgtcttggtaaatttctttaccacttgtgacataggccccagctagttgcacccatggcatacattcctccctccctccagttcctggcaactaccattttactttatgtctctatgaatttgactgtaatactccatgcacttcatatgagtagaatcatacaatgttttccctcttgtcactggcttatatcactcagcatgtcttcaaggttcgtctgtgttatagcgtgtgtcagaatttcctttcttttaaaattaaaggctcaataatataatttttacattaaatttaaacagagtgactatggaagggcagttgtttagtgctctacgaggaggtgattttttagctgagaaagaataaaccaaaagtcagaggaagacactcccaggcagagcaaacagcatgtgctaagtctcagagacaggaaagactgtcatatattcaagactcagaaagggagccaatgtgactggaacttagctaggggattatggcaccatatgaggctcagaaggtaggctccatgtcatgtagaccacaagggaaaatgtcatttgtatatcagtgcaatggaaagccactgaaggattttaaatcagcagagctaacatgatccgtggtgagagtgttggtgggggatggggatgcagaactatctgctttctatgcaccaccctttcttctgtgggctagtcatggcccatcccacctcagggttttttcttatgattgttccctctgcctagaatgctctctccccttccttgtctattcattgtttagatttcaacggagacataacttccttagggaatccttccttgatctcccagaatctattcaaaataatctccatgttgcacatttcatagtaccttgtgactttgctttgtagtacttataatagttttttaaatgaagccatatttgtattttttggttgattaatatatgtcagaatagcagggaccatgtcttctgttcaatattgtatcctgagcacctagtatttaagtaggtatttcagtaaataatgtaacatatataataaataatattaatatttgttgactaaatgaatttaggtctggaccttgatggcttaatgtctttctaaaaatctacttccatatctaagcctttcttgactactttcgcctttttctgtgaacttaaaagtctttattcattgtttgccggatgctaaacatttacaaaagtaatccttatgtcatctgaaattttctatttttttcatattgcttatgctttatatttgctagttggtcttttccctctaaaatgccactagagttatttttctaagttacaaatctcatcatttgtggaaattctagggcatttatcatcccttaaatgatatgtggtgaaagggtagttttattttctgtttgtctcagactaataattttgtaagtgtaataaaaatgaattactagaaagatgaaatttttgtaaagatgaagtataaacctcaaaatcttataagatttaatgacataaaattattctgttaaattgctgtaggaaatttccaagtatttactgtaaattctgtactttttgcaaacaggtaacaaacattttgcttatgaagaccacacattgaatagtagcaccacttaaggtttctgtgcagggataccaggaggttcaaggtgaggcagggtggactctgcctccttgctcccctttcaccagataagctgtgtctttattattgttatgttttacctaacaatttgtttgaagatggttctttgaccaaaaaaggcttaaaaagcgctagtctgcctggtgttttagaatggcatttaaaattattcttcatctgattgcagcccagtttgctagttcagtcactgcttcttgccatagatcctattcttaaaccacctgtcattttctataggccatcatacaagccctttcactacttattacttttccactttcctttgcttagaattaactaaactttcctctctgggatacgatgcattctccaagttctgattgaaaagtcacctcctatgtgaagcctcttcaattcctttggatggaattggtcactacttttaacatacctatggtaactacatactacattctgttaatcgttaatggatttgcttgtctttctcacataacatggttctagtcctgtctatctttatattccctagcccggggactgacacatactcaataaatgttgattggataaattgggaaagtcatcaatatttgtacatatctcagatataaaaatagaagcattttatttggtttcaggcaaactatatgactgcctccttgctcacttctccccactttggggacctatccctggatattgagtatgacatatatactaagagttgaaatatgtgtcttagaaaatgcaagtaatgaacctcctacccaggttctcgtgtgaacttgcattaaagctctgtgtgtgttgggaggtgcagagagaaagttaaaagttattttgaaattatattaattattaatgaaattgttttgattgaaaagtttggaatctgatcctttaaatagcacccttgttttgttttattttaattgaatttgtctgctctttcagttttatgagtgacctttaagtaatctcttattgccaagagaagctgtttgccctctggaaaaartataagatttagggtcatttgaccaagatattctaatcctaaatccagtgattactagctgtgtgacctttataagtcatataaagtctctaaatctttttttcttcacttgtaataaaggaacaactgacatttgtcctatgtaccctgcagaattgtgagggccaaatgaagtggagggtatgaaagtgcaggtaaaccccagaaacaacaaatgcgggtaaacyctacaacagaacttgtgctatttactatcagctctatgactttacaccagttaaattatttgtacctcagtttattcacctataaaatgagaatattaatgcctgtatcattgggtttgttgtgagaattaagttatttataaaaaagtgtctagtagattgacctgagtgtttgattatcagtcaatttacctttgccttagcatcacacccttttctagcctccaccctgaattagggtttaatagtaataattataagaaatgatagtaattggagattatttactaaacactagtgtatgcttaactctatgctagttgctatagggaaaatggagatacaataatcactaatcccttacatttcatttcaactattcagtatttagcactcaccatgtgttagatacaggggataaagaaataaacatgaagcagcattaccctttaaggctcataatctagtagaggaatcagacacaaataaattataatacagtatagcacaataatataaatgtatacacttcatggaagagataatgattttgtctgagagtatgaggaaagcttctattctatgcaaattaggttttaaaggatgagtagacgttttttaggtagactgaggaggtgaaagagggggcgatccagatggaaggagtcagcatatgtagtgtttggaactgyataaatcgtttattactgctgtgtattaaggttaagaagagctgactaaaggtgaggctagagggtaggcaagggctggatcatccgaggatgatttttgtaccatcctggggagtttaaatgtcattctgtgggcaagaggagtcagtgaagggttttgagcagaaaacaaagactatcccttgagtgttgtaggaaaaccactttgatagccttgcaaatgacagagcagggagctttatagattacccaaatgtttgcaggttattatctgattctcacaacaggtctttgaaagttggcaaggcaggaattaatcccatctaatatatgatatatgaaccactgagaattaaagatggcgctggaaattagcttgcatcatatacaatcagtacttactgagcaacgattaaacctaggccttttccaaatctagttgtatttttacgatacattgaaagatacagtccctgccctaaatgaaatttaaaacttgttagggatgattgagggataattttccttaaaaaaaaaaagataaaattacgactctcacacaaatatagaatgaacaaaattttaactcattaatccatgtgggaaacagaaagatagtacaaagatggctcagagaggacccaaagtaccacatatttattgtcagggaatgctgaacttaattcacaaatggtgacaaaactcgtcaatacccataggacagttatcaattgcattacctgggcacagtttgcatttcagtggacaggaattatttgcattactrtgagttttcaacaagctgacatctttcttgacaaagctgtgaaatagcctaattaaagagagaccaagtaacacatctctatacaatcaggtaatcctggaaggctccagattccattgatagaatatgcagtaatctctcttgcccatttcaaaacctcccacaattttatccgacagggatttaggactaattctcagaaaattcagattaggggataaagaaataaacatgaagcaacctcaccccacaaggctcataatctagtagaggaatcagacaaataaattataatacaaaatagtacaataatataaatgtatacacttcatgaaagagatgatttcatgtgggctaggatcttctccagttttccctattaccctatcatcagaaatcagggattcttcatctcaacagaagtatcctttgaaaaatgactgcatcatacagtcccattatgcaatgtcagtttccattctcactttctgtttagattacctgcctaggactcttcttgagtgtttgaattacccctttccagaaatgaaaatctgcctccaaacccaccaacctagttgttggtggaccgtaatacccaagtgaaaaaaggctttagggtgccaggtgtctggattttctaagcagtacttctgtagagttccttggcataatgccatcttccccttagcactgtgatatgtctcggtacagtctcttttgctgtattatagaaggtgcattcctaggaagcctcatgttataaagagttagtatagtaattgtttcaagggtttttttcctatatgaaggtaaaggtgcttatatagctgtaagtatataactataaaatctaaagattttgaggaaatccagtgtttgattttgtttaacttttgcaaaagagtatttctttgcctatcttcaccaacatcactttatcacttttattgtctatttttatggcaaagcaccaagtcacttaaagcagttgtttcatatttgcagtatttctttttctcctttcctttctttgtttaattccttcatgctttctctttcttcttcttcccttcccttgtttccttttcttctttcccttccttcccttccctcactttctgcttgtcttattccttctctgtattccacataaagtatgttagaattatgcaaataatgtttcctaaaaccagatataggtatatctctttgacttaatgctgccagtttaagattatttatctgttcatatcatttgtagatggttctgctctctcaagacttatcactgattgcttgattgcttaatgatgtcaatctccagtcctttgtttcctagctttttttttttttttttttttttttttttgagacggagtcttgctctgtcacccaggctggagagttcagtggtgcagtgttggctcacagcaacctctgcctcccgggtttaagcaattcttctgcctcagcctcctgaatagctgggactacaggtgcctgccaccacacctggctaatttttttttgtatttttagtagagatagggtttcgccatgttggccaggctggtcttgaactcctggcctcaagtggtccgcccagcttggcttcccaaagtgctgggattataggcatgagccaccgcgcctgggccctagccttttttttttttgctatgagcgtttggccatgccctattgaattttgtgtctgtgtgttatatatatataacaaaatttattatttcatcctcttttttttttgtttttgtagaaatggtatcttgctatgttgcctargctagtcttgaactcctgggccaaagtgatcttcttacctcagccacccaaagtgctgggcctattttaaccatttttaaatgtacagttctgtggcattaagtacattcacattgttatgcaaccatcaccaccatccacttccaggatgctttcatcttccccaattaaaactgtacccactaaacaataactcctcattttccacttcctccagcccctgcaaccactactcttactttgtatctctgaatttgactacactaggaacctcatataagaggaattatataacattcgtcattttgtgactgcatgcactcttgaaatttgaaatacggtattgatgatgatggtggtaataatagtgataatggttaccatttagtattgttcttttggccaggcatgctatttgtttaatcttttcaatctatgccaataaatgactttattcatcctcatttgacaattaaaaaagatgagactaaagagattaagtaattaatccaggataaaggatataatctgtgttctctctaagatttctgctttccattacaccaaaagttgatggtattagtcctggttccaacctgtgtcaagatggcattggaaaaggactgagtatgcytcatggttttcttctcctcttatacaccagtttaccttgttcagatttcaaaaacatagcacaagatatgttccattaaaaagatatgaactttattttcagactcctttagattatgcgcttttgtcaaaaacaaggaccacgtctttcatttctgtatttctagcattggcctagcatgtagaagtcaccgtaacatgtgttaacaaagctaaacaaattgtgtgctctgaatctgcccctcgtttcctatccaggtgagttggtttttgagatagagatagctataagcatagttcctgctttcaaggagcttagagtctagttagagatgagacattaaaaaatcaccatcatgaaaatcactttctgtttgaattggttttgcactaaatatgttggctgtaaaatgtatttcagtcatttatagggcttagttcacataacattatttgggaaaattaactattatttcatgagtcaaggaattggatgtacttcctctaaacacatgtacataaactctggtaaaactccttcaactgctgcctgcccacaatgcagttggtgcttgctataatgggtcagtgaggagtgattaaagcaggccatgggtcctccgactggggattgtgtccttgccttgcgtgagcaaataagtcccaatccccaaatacctggcaagtaccttacctcttttttctaatagacttgtcaccattcatcagctcaaaattattatttttaagagaaataatgaaaagcccaattctacagatgagaagaagtttatgttgattaatatataatgtatgaaagagtggttatatgaaagtcaaagatctgaaagaccaagtgacttgtatcttgtatagtactttttttttttttttgtgagacggagtcttgctctgttgcccaggctggaatgcaatggcacagtctcagctcactgcaacctctgcctcccaggttcaagagattctcctgcctcagtctcccgagtagctgggattacaggcacctgccaccatacccgggtaagtttgttcatatttttagtagggacggtttcgccgtgttggccaggctgatctcaaactcctgacctcaagtgatccgcccaccttggcctcccaaagtgccgggattacaggcatgagccaccgtgcccggccacgtttttctatttgatagtaaacactggttactattgagtatactgagctaccataggacttcaattatggtattctgttttaaccccaactattctgatgacatctgacgtatttcaattcagttctgacaccaaccacccagtgttagagtcagactctacaagtttatgagagcatggcccccaacaagacttgccccatttcagatgccagtctcaggtcagatccccaggccacccatacttctgaccagctggctacaaatctgaggggttcccatgatccctttcaggtttgacaattcactggaacaactcacagaacttargaaagtgctgttcttattattacaggcttattataaaagataaatcagggacagccagatgaagagacacttargatgaggcctgggagaatctcaattgcagaacttctgtgccctccttccatggaattggggcacatcacccttctagcatgtcagtgtgttcacaaattaggaagmagcattgagcttcagtgtcaagagtttttattagggtttcattatatagacataattgataactcaatgttcaggccccttccctgccccagaggttgggctggttcaaagccccagccctctaatcatatggtttgttcttctggtcactagcccacatattgaaccatctgactatcagaaactaaggtatgatcccaggggcttatgaataacaaagatatttatatcacttggaaaattccaggggttttagaagctctgtgccaggaacctgggacaaagaccagacaaattatataacacatggtacataagagaaagtttagtgtagtggttaagagtggtttaacagaaagttatttcttttcctcatggggttgtgatgaggtttaaatgtggtcaccagtgtaaagcacttaataccatgcctggtatgtactaagtcttaaatagatattaggtagtattaagaggtgttttagtttcctagggttgctgtaacaaagtaccacaaattagttggcttagaacaacagaaatttattctctcagtctggaggctagaagtctaatattaaggtattaactaggccatgctccctcagagactctgggtagaatcttttcttgccttttcctagctcagtccttggtgttcctgggcttgcagttgtattactccagtctctggctttgatgtcatattgtgttctccctgtgtatctctgttttcatatggtctttaactcttaaggacaccatcacattggatcatggcctaccctaatgacgtcatcttaacttgtttatatctgcaaagaccctatttccaagtaagggcaattcacaggtaccaggggtacacaattttagggacacaatttaacacagttcacaattctggccccctaaaatttatgttcttctcatgtgcaaaatatatccaccccatcccaacatctccaaaagtttcaactccttccagcatcaactctaagtccaaaatcccatctaaatataatcaactcaaaaagttcctaatttcattttttatataatctaaatcagatatgagtgagcctctgggtatagtccttcctgaaacaaaatttattcccatctgctttgaagcctagaaaacaagttgctatttgcttccaagatacaatggtaagataggcataggaaagacattgccattatgaaagggagaaaatggaaagaataaaggagtcactggtctaaagtaagttcacaacccagcagggaaaactgcattagatttcagagcctgagaataattctctctggcttgattctctgtcctctggactgctggggtggccctaccactttagcctgagaatgtctcattggcccagacctctccatctgtggctttgccctcagagccagtcgtcctgcatatcattccatctctgtccatttcagttatggctggtagtacttttgctggtatgaaattctcaaaaaccttgtcagtctcctgtgcaatgcaggtccaatccatctaacaagaatgttctccacatatctttgctacataactgtatctctattcctggcttttgcagagatgattgactgggtttgtgaatcacatgcaaatgctatacccttgccctggccctgtttccagagcacactatctggataggcagagaattttctaaattaccaagtgctgttccttttttgcttaatattaatagttcattcctcaatttatttctttcctctcacattttactgtaagcaccaaggagaacccaggccatacttccacmctttgcttagaaatcgcctcagctaaatgtccaagtttatcacttgtaagttctacttttcacctagtggctcaacataattcggacaagttttctgctgctacataacaaggattgcctttccccaggtgtccaataacatattgatcatttcctttgaaggctctaccagaagcatctttagtgctcatatttctaccaactatctcttcaaggaaatttagactttttctatcaagcatctcaaaattctttcagtccctacccgttaccccattccaaagccacttatttatttttaagtatttgttagagtagtgcaccactcttggtaccaaaatctgtattagtttcctggcagctactagaagatagaagagacagggaaggatcttcagagagagcatgactctaccaacaccttgattttggacttctggcctccacaactatgagagaataaatttstgttgttttaagatactcagtttagagtactttgttacagcagccctgggaaactgaaatagagatgtttcctggaggtactatagtcatcggtgcaaaacagtgagtacaaagtatcttcctccatcctcagattttcctgccatttgtctttctctcatttagagcatatttgtgtctagttgtactgtaaagtttacttttgctatgttaacagcttatgatttggctttatctcaagagatcagccttaagtagggatgctctggtgccaggaagccttcagccttcaaacctttgcagggatggaggctttacttttacagacttcttctgccagaatgcctagttgtggctcttggtttcctcctcatgcaaattcttgtaatgcctgccttcatcatggtgaaggtagaagagtcctggtggtacttcagttagataggcagctgacccataattgatgaatcatataatgaatccttgactgtaacttttaacagatagctgtttttcaattgagttatttttcaagaacacaacttttgcctaccttaatgaggagttatacttatttggattttctttagtgccgatcacagtgtttgcagatctcttagaagatgctccataaaaattgttttgcactgaagaaggcttatccatggcactgctagtgagagactagctctagcgataaataagagatgttagttgccagggctgtcatttcaatttgtcttgcttttactgagctcattaataaattgccacagtggtaatatgaaagtaatgaaccttctggagacccacctggggcacagaatgctaacagggaccttcagggcaactgccattgtgatacacaattcagtgaaagggttttaggcttttttcccctttgaaacatttatattttgtaatatccaaatcctatgttaacatttgtgtactttctgagtatatttaaattcagctcagcaaacatggatctgatgcctgctactgtcaggcagtatattggatcccagggttgtaaacatgaatgagacatcccttagggcttcactatcaaatagagagaaaaggtgggtaaacaaataattttaatatggtatttaaatgccataagtatgggtcagatataaatgtagcatacaagaggaaatgattatctagagaaaggagctaggaaagctgagaaaggggactcattgatttctgagttaaaatttgaaggatgggttataggttgatgagttgggtgcatagtaggaaaaggggcctcattgcagataagaggagggactgcaaatcatttggaataacttagggaaagaaggtaaagagaagattgtcagccctagatcctgaaaaataaaataaaataatgtaaagagaagaagtagatgaggatggagacataataaggggccaaatcttaaaggatttaggttttgaagtgttatgtatactgtgccaagggttctggtggattttatcttgtagggtacatggatccattgaaagattttaagcagagaagccacatgatcaaatttttatttcagaagaattattctggttgtcttttataggatggaatggaagtggagagagaccaattagaaagctatttactaattctctgtaaggaacagcatagtagactgcaaaaagcatgacttaggttgtttcaaatcccaattcagccacctactaactttaacacttaactgtctctgaagcctcttcattaatgaaatggaaataatagtaatctctcactggatattatgaaaaatcacaaaaaataacatacacatggagttgttccaaagtgctgagtataaatgctagctgttatatttcaaattctgtttttctcgagttttaggtaacataactacgtttagcattttgaagaagcgctttcattttccttctaccattctgttgcaatgaagcagaagttgagacattttcaaacactttatatttacattaagatccatatttcaggatttcccaaacactcaaaaaataatataactaaagctttttcctttggacaccctgtcagaccctcaattggagaatcagggttagtgtctttttttttgagtcagggtataatgggaaaagattggagccctgtttcaacaaatgagctatttagctgagaaatagcatcagaatatgttctgcctccatcctgcaactatttaataagaataatgtgaacagttgtcctagccatcttgcatatttattgtgaggatcacattctttccttaggtaaatgtttattaaataactactattcaaggccctgtttcaaagaatgtagaaatgaatcagatctagatcctaatttcaagtgaattacttgaaatgtaaaaggtgtatacaaataactaattcaagtaagacaaaatatgagtcagataatgttgaaaattataaaggactttgacacttaagttatttatattttgtataattattgtatattgttatattttgcaaagtatatttcacattgctctcattatttaaagcgccaccccaagtaaagcagagatagagtcactttcttggatatctgtagaaaataaatgataaatgtttttagatttcaggtcaatttaaaaacctgtacacagatttttatctcaggcttaatgttcactgatacccaagtaacttggttaagttagtctctgagcctcaggtgtgtgcatgtatgtgtgcatgcatgtgcacatgtgtgtgtaattgagatagtaccatctagctcttagatttattgtgatgagatggtctttatatgtaaaacaatgctaacaatacatgttgggtttttctgtagtctctttgctgtcacctacttaccttttcactattgcccagtattgagctttgagacagcagcttcactgaaataatttaaaggtttttttwaaaaaaaaatgtaagcaattataggggaggaaaatgtcttttcctcacctgtcctaggttcatggctaaagtccttatagcaaaagacatattaacaagagaaaagcataatcagtgttttcttaagttttatgtgacacagagggcttcataaagaaatgaaaacctgaagaaacagttaaacttgtatatttttatgctagatgtgataatgaagtagataattggggagcaatagaattggacaaagcgggtatgatctaatggtaataaatggggggtaatttagacttgtttgttcagattcttcttggtctctctgtgtctttggctcctttcctctaggaacctgtcacatgagggtcttatgacttgcttctggaagagttcagaaaacccataaaacctgggaaggttttatgtcctgctacagaggaggagatggaggaaggtgaaggttaccttcctgcttctgttgttttcccacattccttcagcttaaaatatttggggattaccatgtcctgaagcccatcacaaacatacaacaaaagtgaaagggtttataatgaaaaacattatagccacaagctaaattttaccaatacttgtaaatatcacatatctatgtgtcttccctttacccaccagctgtattcaaatttctctattgattctttgggacttttctgtaaaaggtttgtaactaatttggaggctgggaatgcaagtatgtttcaaatatttgtaattaaattgtactttaacaacttacattgctttttacctctgatgaattttatttaccaagttattyattatttggatctatctgtactattcgtgttcctacactcttatttgtagcatggattcatttactggcatacagatcatccattgcattttccagagaatacctttagttaatcttttttaatgtcaaatttatagtaggttctttatattagtccttgtctttttctcctgttaaaatatgtatctttttttttccctccagacagagtctcactttgttgcccaagctggaataaagtatgtatttttaaaaattaatttaaaaaaatgatgctgcatattttgtgcctagtggcaaacactgcagctaaaaagctctgtgtgtacagagtgggttgccagcatggtcttaaaatctcatgtatctcaatattttctatcatgaccgtttcttgtttctgagcttggggtggttggtttgtttttcaggaaaactggactatttagtatggctaaggattaaatacagtcttttgcctatgtttggttagagcctctcagctttgattgatgttctccattatatgttacagaaatttttgtttctggttctttgatgtcactctttcctattttctggtactgtaaagtatgtactcatatttgtaaaatcttttgtcatcacaatgcatatcttttaaatgagttttaattagatagaacatgtctttttattacatggatttccttaagctgtaagaactgtattcagaaaaatctttgaaaagctaaattttttattcttatttttctgagtctgcttcctagggaatgaaaagctaaaattatattcatgattgtgtctcccaactccttccatccactcattacctttatgtaatgatcctgttgaatttgagagtgacttacaaatactaaagtgcccgacttgttttgtttcgtatttatttatttatactttaagttctagggtacatgtgcacaacaagcaggtttgttacataggtatacatgtgccatgttggtttgctgcacccatcaactcatttacattaggtatttctcctaatgctatccctcccccagctccctaccccgcaacaggccctggtgtgtcatgttccccgccctgtatccaagtgttctcattgttcagttcccacctatgagtgagaacatgtggtgtttggttttctgtccttgtgatagtttgctaagaattatggtttccagcttcattcatgtccctgcaaaggacatgaactcacccttttttatggctgcattgtattccatggtgtatatgggccacattttcttaatccagtctgtcattaatggacatttgggttggttacaagtctttgctattgtgaatagtgccacagtaaacatatgtgtgcatgtgtctttatagtagcatgatttataatcctttgggtatatacccagtaatgggatcgctgggtcaaatggtatttctacttctagatccctgaggaatcaccacactgtcttccacagtggttgaactaatttacactcccaccaacagtgtaaaggtgttcctatatctccacatcctcttcagcatctgttgtttcctgtctttttaatcgccattctaactggcgtgagatggtatctcattgtggttttgatttgcatttctgtgatgaccagtgatgatgagcattttttcatgtgtctgttggctgcataaatgtcttcttttgagaagtgtctgtattcatatcctttgcccactttttgatggggttgtttgtttttttcttgtaaatttgtttaagttcttcatagattctgtatattagccctttgtcagatggacggattgcagaaattttctcccattctgtagattgcttgttcactctgatgatagtttcttttgctgtgcagaagctctttagtttaattaggtcccatttgtctattttggcttttgtttccattgcttttggtgttttactcatgaagtctttggccaggcacagtagctcacgcctgtaatccctgcactttgggaggccgaggcaggtggatcacgaggtcaggagattgagaccatcctggccaacacggtgaaagcttgtctctatgaaaaatacaaacattagctgggcatggtggtgtgtgcctgtaatcccaactactggggaggctgaggcaggagaatcgcttgagccagggaggcggaggttgcagtgagtcgagatcatgccattgcactccagcctgagtgacagagcaagactccatcttaaaaaaaaaaaaaagtcatgaagtctttgcccatgcctatatcctgaatggtattgcctaggttttcttctagggtttttatggttttaggtctaacatttaagtctttaattcatcttgaattaatttttgtataaggtgtaaagaagggatccagtttcagctttctgcatatggctagccagtttccccagcaccatttattaaatagggaatccttcccctatttcttgtttttgtcaggtttgcaaaagatcagatggttgtagatgtgtggttttatttctgaggcctctgttctgttccattggtctatacatctgttttggtaccagtaccatgctgttttggttacgtagtcttgtaatgtagtttgaagtcaggtagtgtgatgcctccagctttgttctttttgcttaggattgtcttgtctatgtgggctcttttttggttccatacgaactttaaagtagtttttttccaattttgcaaagaaagtcattggtagcttgatggggatggcgttgaatctgtaaagtaccttgggcaatgtgccattttcacgatattgattcttcctatccatgagcatggaatgttcttccatttgtttgtgtcctgttttatttcattgagcagtggtttgtagttctccttgaagaggtccttcacatcccttgtaagttggattcctaggtattttattctctttgtagcaattgtgaatgggagttcactcatgatttgggtctctgtctgttattgatatataggaatgcttgtgatttttgcacattgattttgtatcctgagactttgctgaagttgcttatcaacttaaggagactttgggctgagacgatggggttttctaaatatgcaatcatgtcatctgcaaacagggacaatttgacttcctcttttcctaattgaataccctttatttctttytcttgcctgattaccctggccagaacttccaacactatgttgaataggagtggtgagagagggcatgcttgtgccagttttcaaagggaatgcttccagtgttggcccattcagtatgatattggctgtgggtttgtcataaatagctcttattattttgagatatgtcccatcaatacctagtttattgagagtttttagcacgaagtgctgttgaattttgtcaaaggccttttctgcatctattgagataatcatgtggtttttgtcgatggttctgtttatgcgatgaattacgtttattgatttgcatatgttgaaccagccttgcatcccagggatgaagccgacttgattgtggtggataagcttttcgatgtgctgctgagttcggtttgccagtattttattgatggtttttgcatcgatgttcatcggggatattggtctaaaattttctttttttgttgtgtctctgccaggctttggtatcaggatgatgctggcctcataaaatgagttagagaggattccctctttttttattgcttggaatagtttcagaaggaatggtaccagctcctctttgtacctctggtagagttcaactgtgaatccatctagtcctggactttttttggttggtaggctattaattattgcctcaatttcagatcctgttattggtctattcagagattcaacttcttcctggtttagtcttgggagggtgtatgtgtccaggaatttatccatttcttctagattttctagtttatttgcgtagaggcattttggtagtttgtatttctgtgggattggtggtgatatcccctttatcattttttattgcatctatttgattcttctctcttttcttctttactagtcttgctagtggtctaacaattttgttgatcttttcaaaaaaccagttcctggatttattgatttttttgaagggttttttatgtttctctctccttcagttctgctctgatcttatttatttcttgccttccgctagcttttgaatgtgtttgctcttgcctctctagttcttttaattgtgatgctagtatgttgattttagatcattcctgctttctcttgtgggtatttggtgctataaatttccctcaacacactgctttaaatgtgtccctgagattctggtatgttgtttctttgttctcattggtttcaaagaacatctttatttctgccttcatttcattatttacccagtagtcattcaggagcaggttgttccgtttccatgtagttgtgtggttttgagtgagtttcttaatactgagttctaatttgattacactgtggtctgagagacagtttgttgtgatttctgttcttttacatttgctgaggagtgctttacttccaaatatgtggtcacttttattttttatttttatttttttaatttttttcttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtccttcgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgtggtcacttttataataagtgcaatgtggtgctgagaagaatgtatattctgttgatttggagtggagagttctgtagatgtctattaggtctgcttggtgcagagctgagttcaagtcctggatatccttgttaacctgtcttgttgatctgtctaatattgacaatggggtattaaagtctcccattattattgtatgggagtctaagtctctttgcaggtctctaaggacttgctttatgaatctgggtgctcctgtattggatacatatatatttaggatagttagctcttcttgttgaattgatccctttaccattatgtaatggccttctttgtctcttttgatctttgctggtttaaaatctgttttatcagagactaggattgcaacccctgcttttttttcactttccatttgcttggtagatcttcctccatccctttattttgagcccatgtgtgtctctgcacgtgagatgggtctcctgaatacagcacactgatgggtcttgactctttatccaatttgccagtctgtgtcttttaattggggcatttagcccatttacatttaaggttaatactgttatgtgtgaatttgatcctgtcattatgatgatagctggttatttgcccattaattgatgcagtttcttcataacatcgatggtctttacaatttggcatgtttttgcagtagctggtactgattgtttctttcaatgtttagtgctttcttcaggaactcttgtaaggcaggcctggtggtgacaaaatctctgagcatttgcttgtctgtaaaggattttatttctccttcacttatgaagcttagtttggcgggatatgaaattctgcgttgaaaattcttttctttaagaatgttgaatattggcccccactcgcttctggcgtatagggtttttgctgagagaggcactgtgtctgatgggcttccttttgtgggtaacccgacctttctctctggctatccttaacattttttccttgatttcacccttggtaaatttgacaattatgtgtcttggggttgctcttctcaaggagtatctttgtggtgttctctgtatttcctgaatttgaatgttggcctgccttgctaggttggagaagttctcctggataatatcctgaagagtgttttccaacttggttccattctccctgtaactttcaggtacaccagtcaaatgcagattcttttcacatagtcccatatttattggaggttttgttcatttctttttactcttttttctctaatcttgtctttttgctttatttcattaatttgatcttcaatcactgatatcctttcttccacttggtcaaatcggctactgaagcttgtgcatgtgtcatgaagttctcgtgccatggttttcagctccatcaggtcgtttaaggtcttctctacactgtttattctagttagccattcatctaatcttttttcaaggtttttagcttccttgtgatgggtttgagcatcctcctttagctcagaaaagtttgttattaactgaccttctgaagccttcttctgtcaacttgtcaaagtcattctccatccagctttgttctgttgctggtgaggagctgcgatcctttggaggagaagaggcgctctggtttttagaattttcagcttttctgctctggtttctcaccatctttgtggttttatctaactttggtctttgatgttggtgacctacagatgggattttggtatggatgtcctttttgttgatgttgatgctattcctttctgtttgttagttttccttctaacaggtccctcagctgcaggtctgttggagtttgctggaggtccactccagaccttgtttgcttgggtatcaccagcggaggctgcagaacagctaatattgcagaacagcaaatattgctgcctgatcctttctctggaagcttcgtcctagaggggcccctgcctgtatgaggtgtcagtcggcccctactgggaggtacctcccagtgttgggagaaccactcctctcttcaagctatcagacagggatgtttaaatctgcagaagttgtctgctgccttttgttcagctatgccctgcccacagaggtgaagtctatggaggcagtaggscttgttgagctgtagtgggctctgcccagttcgagcttcctggccactttgtttacctactcaagcctcagcaatggcagatgcccctcccccccgcgaggatgcagtgggaaatcaggggtctcacagccttcagagctgagagccccgaattgattgaggtcagtctcagactgctgcgctagcagtgagcaaggctccatgggcatgggacctgccgagccaggcacaggagagaatctcctggtctgccagttgctaagaccatgggaaaagcacagtatttgggcagaggtgtactgattttccaggtgcagtctgtcacggcctcccttggctaggaaagggaaatcccccaacccttgtgcttcacaggtgaggtgatgcccygtcatgcttcggcttgccctccgtgggctgtatccactgtccaaccagtcccartgagatgaaccagatacctcagttggaaatgcagaaatcacccgtattctgcatcgatcatgctgggagctgcagactggagctgttcctattcagccatcctgcagttcagtcatttttgtttcattttaagagattttccttaactgtttttctctcagaaatcaatttgtgggttgtaattataagccatccaagtataatgtattttcaattcagtaagtagccactattctggtcatataattttttagttttgtgccttttttccttactattaaattagcatatacccatttcattaataaatacctattgagtatctcctcttacaccaggcactattccaggtgctgggatataatgctgaatgaataacataaacaccccagtgagagagacaaataaatagatatggaaaatattaaatggtgctaactgctatgtggagaattaagagtggtatgatagaaagggtctaggtgactactttagtttgagtgatcagggaaggattctctgaggaggtgacatttaagctaagacctgaatgatgaaaagccagacatgtgaatattgaggtggaacattccagggagtgtaaaggccccaaggtcataaggaacttggcytccaacaggagctgagaagaccagtatagctggagcaaagcaaaaggtgagagccataggagatgaagtagaagaggtaagtaggggtcagatcatgcaggactatgtgggccaggataaggtacttggatttgatttgaagtgctatggggaggctttgggagattttaagctggagagtgatatgatctaacttaccttaacatatagtcaggacaggatcatatagggaagaaaataggtcaatactgagaacctgtaattcaaacacaggaaaaagattgcatttgctgctaaggcgtactaaatagcccagttttccttgaaaaatcctaagcctaagagacaagaaatttggccaaattccattgttttgattcccagctccaccatgtaccaactgtgtaaccttgggcaaattataagatatctctctgcactggtttctcatcattaaaatgaagataataatagtgcctgcagataataatagtgcctgccttatagactagtgaaaattgaacaacattgctgagaccagctcggtcggggagaccctaacccagcggcgctagaggaattaaagacacacagaaatatagaggtgtgaagtgggaaatcaggggtctcacagccttcagagctgagagccccgaacagagatttacccacgtatttattaacagcaagccagtcattagcattgtttctatagatattcgattaactaaaagtatcccttatgggaaacgaagggatgggccaaaataaaggaataggttgggctagttaactgcagcaggagcatgtccttaaggcacagatcgctcatgctattgtttgtggcttaagaatgcctttaagtggttttctgccctgggtgggccaggtgttccttgccttcattccagtaaacccacaaccttcctgcgtgggcgttatggccatcatgaacaagtcacagtgctgcagagattttgtttatggccagttttgggaccagtttatgaccagattttggggggcttgttcccaacacaacataatacatggaatgtgcttagagcagtgcttggcacataataagtacttaatagatgtttaattttatatttcctttagaactgtgtttttgatagccatgtggttaatatgactggatgtaatgaattttttattttattttattttaagtaaatttaaaattaaaaacggatctcaattcaggtattagaaaaattttaagtatgtttgaaacaatttggatatgtgaattttctatgtgaattttctttttcaagtgtaaatttacaaaattgaaatacggatcaagtatttgtgatgaaaatttagcatctgaattgaggtaagctataagtgtaaatgtataccagattttaaagacactatacaaataatgtattttcattaatgatttttatgattacttgccaaaataatatgatatactgggttaaataaaatgcattattaaaatcatttttcacttgtttctttttttaaaacttttaaaaatatgactactagaaaaatgtaaaagccacctatgtaattttatatttttctagtaatcatatttttaaaagttaaaagaaacaagtgaaaataattttaataatgcattttatttaataaatactgaacattatgcttatatttctgttggatagcactgttctagaccctgggtcaggggaagggtagtaggagaggcatatagactaggagaggtgctttttctaattacacaaatacctctagagattctgaaacaccttcatccagtggagcctccctccccatcatattactcctacctcctattcccttgctgaaaatcagtgctcttagtgagtctgccctcactgataagagtttgtattcttcaggagtgtctgggtgcaaaaagttatgaattgcactaaatttaacaaggttagacacccattaatgatttcgatgaaataaatttttggagttctctacactattaaatagtatggtactaccatataaaagtacagtaaagtctaccacgaatcctggtccaatggactccagaggcttaaagtgagaaagaattaaagtagattttatgaaagtaagggatgaattactaggtcaaaagctgaggaagttgaggaaggcatcttgtgttctaaaaggtaaatttctgggagggaaaaaaaaaaaaggctgggcacgttggctcatgcctgtaatcccagcactttgggaggccaaggcaggcagatcacaaggtcaggagtttgagaccagcctggccaacatggtgaaaccccgtctctactaaaaatacgaaaattagccgggcgtggtcgtgggcacctgtaatcccagctactcgggaggctaagacaggagaatcacttgaacccaggatcttgcagtgagccaagatcgcaccactgcactccagcctggccaacaagagtgactctgtctcaaaaataaaaaaactcaaaaagctaaataaccataaactttggtctctgaagtgaaactggacatgtgttatttttctcacgcctcttggttcctgctagttctgtgcttgcatacaaagatttcctgagttatttaaagaggcattattctcaggagttggcatgaagaaggttcctagtaaatactgagcactattctgcctgagctgtttagattgcttgttctatattctttttacattgccttaaattaatttttttaaaaaaaatcaatgatatcccttagccaaatacctattacctttcaaagattatttcttgccctcttaagtcacttcgctagagaagagagccccttcctgagttctttaccatttcggagtcacagaatacacatttcactggaagccccttgttggtgagagaagaggtagtctcagagtttcccaaccagaaatgagtgtcaaggcaattgcttgagttgctcattggaagacaactaatatcacttgataaggttccttatttcaattttctgtgaagccataaaatcagatacttgtagaggtgaatgatgaggaaacaggcatgcagctagtttgcagtaaatgtaggacccacctgggaaggcactaagagaacacttgagttctaaccttctgttttctgttgaggaattggcagccctgaggaagtgacttctcagtagtagaatgaaccaggctaaatctagatctttcatctcagtttcttgatacagagaaaccatgtttaccctcaagtttgtaattctgtaggattcrtacaagaccctagataatgccatggatttataactccctcagtttttaaaagataagaatctgagactttagagaggatttacagaatggtttatggatgctgttctgtcaagttcaaattactttatttacccatcttcatggcccaagtagttgaggatctaatctattgtcagggctctttgtccaaggagatagttttctatataggattctaacctattagactgtaagaggttaaagttgatcttgagatctctggtcccttgtaacattgacatctttcaacggtctgcttaggcagtgtgtgaactgataaaaaaaaaatggtaaaggttagtaatctcttatctgtccscaaagccatatgagtgagacctcagctgttcattttgttatcatgaaaagcttttattaggtgactcctgtttatagatgatgacatgcattcaaatcttcactccagaaaaccttagagaaaaagccattctaagaagcgtaatgttctggagagctacaggattgttccattatagattaaagttttatttttaaaaattattttagttggaaattattttaaaatggatcataccccttcttccctttaatttagtttaatgagactaatttagtatgtttatgtgtgcgtgtgtaaaggatacaaagttccatgggtttttagtatctattcctaactctgttttcctcacaagcattattattattattattattatattattattattattattacatttatttatatatttttttgagacgagttttgctctcgctcaggctggagtgcagtggcgcagtctcagctcactgcaagctccgcctcctgggttcacgccattctcctgcctcagcctcctgcgtagctgggactacaggtgcctaccaccacacccagctaatgtttttttgtatttttagtagagacggggtttcaccatgttaaccaggatggtctcgatctcctgaccttgtgatccacccgcctcagcctcccaaagtgctgggattacaggcatgagccactgcacccggccacaagcattatttttatagaattgtgaggtttccaggaatgtatacagttgtaaaaaacacctagatttaagtctgtggattacaatcaaaaaagatctgaaagccagtgccaattagttccttccttgcattaataacacttttttacatttgtttaagatttgcctgtttgccaagcctctgtacatacacactgtatatggtctatgataagtaaactagggatggtcttcttcttgttttaaactatactaggcaggcataaggaaaccgaaaagaggatggactttgaaatcaatctttctttgatttgaattttaatttagattcagggggtacacgtgcaggtttgttacaagggtatattgcatgatgctgaggtttgggcttccattgagttcatcacccagatagtgaacatagtacccaataggaagttttcagcatcctcccacccccaccccctattgtggagtccctagtgtgtattattcttacttttatatccatgtgtacctgatatttagctcccacttataaacaagtacatgtgatacttggttttctgaaatcagacaacctttaatattagcttttgcatttagaagttgagtgaccatgggtgccttaaccttaacttccaaagttcagcttaaaaaaaatctaaatgggaacagtaatgccagaattgttgggtgctttaagttaagtaataaaaacacctaccaggagcacagtggatgactctcacaaaacaaaatgttgagtggaaggaagtggacataaaagagtacatatgatatgatttcatttatataacattcaaaacaggcaaaactaacctacggtgatagaagtcaagacaatggctactcttaggtggagcagtaactgggaggggagggcacaggggatatttattggggtgctagtaatgtgctctttcttggtttggaggtacattataaaaattcactaagcttgtatacttatgatttatgcacttttggataataatgttatagtttaataataagttatttttaaagtgcctaacacatagtttatgctcttctgctatgatggttctttaggttaacaacatgaaaatttrttttaacagaatgatcctagcctcttttccttgtaatctttccatttctttgttctgtaatagttcctttttcctaattccagttttataccttggcgtgtttaataaatatatactgatgataatcccaattggtgtagttggaggagtttaggtcagtcaggcaaggtgaaattgaatgtcactgtcatctaggagtatataccattctctgatctttagatgatttggtgatattttgcttttcacatgaagatttccctgatttgtgtaatacgatcttgttgaatatcagacagactctatcatttactttttaacggtgaaatattggacatattctgttatttcttgcacttttaatgcaatccaattatagtgtggtgggctttgaaatggtcactgtcacaccctgtagcaccttacagtttttccttgggttcttgttgctaaaagagaaccatgcttattgtttttatcttaactatttttgtactacaagggtagaagtagacttatatactagaaaatttatgaaagctcctgttwtaaaaaacaattcttgaaaattcaaattttaaaaactgaggaagttacttcttctgctaagcactgctagacaatgtgtaggatataaaataagcctatgacaatctctgccctcacagagggtggactcctgctataaagacaggcttctgctttgtgggggtagatagaaaatgagtttgtccacacttactttttgtcttttggatattggctttgagagaaagtctctgatggagatgctagcaagcccctctaaaccccagagaactgtggtgatgatcatatggattcagttggagccaagagacaaagaatggactgtgacttcatcagcgatcagtaatatgacaaagtgttggggggctgaggcagcaccctctatatatcagacacttacttacattaattcatgaaaatagatcatgacattgaacgtttcctaaccttggggtaggcactattacttccattttaaagatgtagaaattgaggtccagagacacttagtaacctgtccaagtttacatagctagtgacaaagttagtattcaagcccaaagcccatctgtactgcatgctatgtatagatagtaacattatccagaaaaggaatatgtttattagaagatgaacagtttggaaacatgttaaacaggaagtcataaagaaagttgatagaggactacatctaggactacccaggaaaaggaattctgtggctcaagattggatttcttgaaagtccccatgaagctctttgtgttccttttgcaagacagttgaatgaggctttcaaacactgatgcacatccacctgttgcctgtttttttttaattgtggcaaaatatacataaacttaaagtttaccatcttaagacattaagtacatttatagtgtgtgtagcctgcaccattatccatccctagaattttttttaatcatcccaaatagaaattctgtacscattaaatataactctcctctctccaccagttccctggtaacccttatttaactttccatctctataaatttacctattataggttcgtcctgtaagtagaatcgtacagtagttgtccttttgtgtctggccagtttcacttagcacagtgccttgaaggttcatccatgttgtagcatttatcagaattgcattcctttttatggctgagttttccattgtatgtgtataccatgttttgttaatccagtcatctgttgatggacacttagattgttttccacttttggctattgtgaatcatgctgctatgaacattggtgtacaggtgtgtttgaatccctgctttcagttcttttaggtatataactaggggtagaattgctggatcatatgataattccacatttgactttttgaagaactgccaaccattttccacagcagctataccattttacattcccaccagcaatgcatgatggttgcaattttcccatatcctcaccagcatttgttatttttcttttttcataacagccatactaataagtgtgaagtagtatatcattgtaggtattttttgcatttctttagtgattattgatgctgagcatcttttcatgtggttattggccatctgtatatcttctttggagaattgtcttttgcccatttttgaattgggttgtttaggtttttagttcttcttgttgttgaattataggggttccgtgtatattttggatatcgacagactacaaacatgatttgcaagtattgtctccgattctgtggactgtcttttcactctgatgataggatcttttgatgcacaacagtttttcattttggtgaagtccagtttatctgttttctgttttgttgcctgtgttttatctgtcatatcctatagtcattgccaaatctaaaatgttaaagattttcccctatgttttcttctaagagttttatagttttagctcttacatttatttaggtcattgataaattttgagttaatttttttgtatatggtataaggtaagtattcaacttcattctcctgcatctggatattcagttttcccagacctgtttgttgaagagtgtccttttcccattaaatggtcttgggacttttattgaaaattaactatttttgagctctctgttctattacattggtctgcttatctatccttatgccaatactgtactattttgattactgtagctttgtagtacattttggaattagaaagtgtaagttttctaactttgttctttttttcaagattgtttgagctatttggaatcctttaagattctttgtgaattttaggacaactttttctatttgtgcaaaaatgccgtttggattttgatagggattgcgttgaatctgtagattgctttggatagtattgccatcttaacaatattagtctttcagtccatgaacacagaacagagtatcttttcatttacttacatcttctktaatttctttctgcaatattttgtagttttcagtgtacaagtctttagccgtgttagttaaatttattcctaaatattttattctttttgatactatttaaatggaattattttcttaattttctttgcacactgttcatagctagcatatagaaatgcaactaaactttgtgtgtgactttgtatcccgcaactttgctgaattcatttattagctctaatagcttttttgtggratctgtagaatttcctacatataagagtatatcatctgcaaacagagatcattttacttcttcctttcaaatctgaatgcctttaattcctttttcttgcctaattactttagctagaacttccagtactatgtttaatagaaatggtgaaagtggctatctttgtcctattcctaatcttaggggaaaagctttcagtctttcaccattgagtataatattagctgtgagttttttatatatggcctttattatgttgaagaagttcccttctattcttagtttattgtgtattttcattataaagcacattaaattttgtcaaatgctttctctacattgacattaccatgtgccttttttttttacttcattctatttatggtatattatgttaattgattttcatatgttgaaccatccttatattctgggaataaacctcacttggtaattgtgtgtgctcttactatgctactaaattttgtttgctagtattttgttgaggacttttgcattcttaagggctgtttttgaaattaaagttttattggaacacagccatgcccattcatttctgtatgatcggtattatctatggctastttcatgtttcaatagaggccacacggcctggtaagctgcaaatatttattatctggccttttttttttttttttttttttttttttgagagagagtttcaatcttgttgcctgggctagagtgcaatggtatgatcttagctcaccacaacctccacctcccaggttcaagcaattctcctgcctcagcctgcccggtaggtgggattacaggcatgtgccaccaagcgcakctaattttgtatttttagtagagatggggtttctccaggttgctcaggctggacttgaactcccgatccacccacctcggcctcccaaagtgctgggattataggcatgagccaccatgcccagcctatctggctcttcatagaaaaggtttgcaaacttctgagttagacaaacaatttcttactctggttccacactgcccaagaaatctgattctcatttggttcctgtgtagatgcacctttaaagtcaaatggccctggtcatgtaccagtaaatattttaggcggttatatttctcacagtaaattaataaattaacattctagtttacctattattgtgtaatgacctatagctctatccaaaagagtctgytccatttttaacagaatcagggttctgaactcataaagctgaggaaagtatcctggaaattggaaacttaaccaaattgctgcccttgagaagccctgtctggataaccagccttctggcttcctctgatgaaatctaatttcactgcatatcttctttgatctacagtakttcatatttctatttttttctatctttcgcttttagatttctacatcgtactaaggaagaatgatttcctatttgatatagctgaaccatgcaaaaatcagatccttgaaaaggtcagaacctgtatttatacatagtagaaatagagagttatcctctattaggctgtgtatgaatatatgtgtcacaaaaaacagagcaaatgaaaaaacttcccctttcttgacattttattctgcagtttttacaaattatgtgtgcctttataatgtgcaaactacactacttaaaagtatgtgtagagtactgttattaatcctgttttatagaaacaataatgggctaagagacttattcaaaatcctgtaactaatagctgtaagataaagcccagatcttttgcctctaagtcttaacctttccactacattgtaagttcgtaattagtatcagaatttagtagacatgtagtatgcaagctgtatgaacattggaaataatgtatataaaagtctatgaaaaagtgttaaaacccctttatggatgttaagtatcataaataattcagatcttgaccttcaatagctaacatataatcttgggatgataccagagtcctcaatatataatataccattggcttagtatagcaagcaaaattctttacaaggtgcctcatttctacttttctagcctcagctcattcagtttctgtcatctgtccctgtagcttactttgtcccttttcatctgtaataaatggctagcattgtccaaacacattgtccctttccatttctatgttcaattccacataattaggaagaatgcctgaaatgcctatttgtctttcttcggataatcctagctcaacttcatctcctccatgaagctttcctcaacccccccccaacccctggcaaagttaatcattcccttctgttttcccagagcactttttatagcaaatctctgtatagcaaaaatcacacgatgattgtatatttgaattgctatctttcctactaatctgtgagttctttgtgagcatgaacagggacttacacttatttgtctttgtgtctttaacatgttactactaggcttagattttgttactcagctcagatgtattttgtttaatgaataaaataagagctacagttctttccttataaggatctgtatgtacagtattctaagtgggagactgaccacacaaaaatacctaaaaacacatagatatatgtaaaacgatatagtgtatgcttgaggtaaaataatggaatgatcagagccaggttgagttatttagggaaggattcctctaggttagtagttggcaatctatggcccacaggccaaatctatctgccaccagttttttgtaaataaagttttactggaacatagccatgttcatttgttagtgtattatatgtctgccttaatgctatgataacagagttgagcagttgcaacagagaccatatgtcctgtaaaactgaaaatatttgccatctggccctttacagaaaaagtttgccaacccctgctctaggagtgggctttggatatgaaaagaagaggaatgtgaattggtgaagcataagtgtgcatcataatgcaatgaaaacaagccatagtagtaggtatgctaggtaagaaagctccactccaattcagtttgtcagagagacctatgctgaagagattaaatgtcaagaatgtttggattgagaaagagggaacacaaatctaatggaaagaaattttgaagtaaacactccgggcctgcagcaaaatagtttcctaaatagtagcaaaggatgatgatgaaggaaaaggaagcagcaacataaattaacattgactgagtgtttactatgtgccaggtactgttctaagtgktgtgtgtgtgtgtgtgtgtgtgtgtgtgtctcctatttaatcctctcaacaactaaatgagataattgctattattgtctttattttgctgcggaggaaactcaggcacaggaggctaagttaacttggtcaagttaatacaactggtaagtgatagaaccaagtctgaacccaggctgtcagtctgcagagtcttcataatagagaaggggaaatctggagatatttggtaaaaatacttttaagcttggagtaaggtacttagtccaagtaattgggaaatgtactatcccaacatggtaaagagaaaatgaacagacaataaaagagtaatgatggaaggcagggtttccaattagaagagtatactatggattaggcagaatgggcagggcaaggaagcagatacttaagacatgttatatagtcatacagtaagatacattatatagtcagtcattgcgtttaaccttgatgagaccagaaagcaattaacttttccttgcacacatgaaagctgtcctaaaatacttgaagagctggtatatccaattgagatatagattagcagtgactttcaaggaggtaaggggcattcaaccttcccacaaaaatatacacaccttagtatcccaagtgtattataattggtggaggtgtcaagtcatagcacacaccattctctctcattctgtctccctaagaggactggttcctgtccaaccctgtatgattgctatggtaaatatttacccctttggacaatttttttaaaaaaatacatatatattgtatgcatgttaaagtaatacatatgcactatgaaaattttgccaatagaagtataccaaatgcaaacattggctagagatggtaggattggagatggaaggaggaggagacattaaactaaatgactttcaacatttcttccaaatctgtagttctatgtttataccagcagagtggtaagcacaaaggaaaagaccacaatgtgactttgacatggttggcttgaatagaggataaaatggtataggagaaaatccaatatatgaaatctaaatttatagagcagattactttgcagtgaaccttggacttatttttataaagattacttttaactagccattttgatatgttcaaatatacttaattttaataaaaaatttcatttacacttaacttgtcagtagtatatttactgtgtaaaataaagcagacacacattgttcattatttcaaagaaggaagagatttcagccaagttatgttgtagtagctacagtggaaataattgagctgggccttgcccataaacctgcaatatgatagaacttaaaaggggaccaggcatggtaactcacacctgtaatcccagaactttgggaggccaagacaggaggattgcttgaggccaggagttcaagaccagcctggataacatagtgagacctcgcctctacaaaaaataaaaaagttagccaggcgcattgatgcacaccagtaatcctagccactcagaaggctgaggtgggaggattgcgtgagtccaggagtttgaggctgcagtgaactatgatcatgccactgtactccagcctgagcaacagggtgagaccctgtctcttaaaaactaactaacttaaaagataccttaggtatgtaaggtatgtaaagtgcctaccacagtgccagtaaatggtagatggagacgcagaagagaaaaaagatgatggtggtgatgatgctgttgttatgtcttctgtccccatatcacacttctgtaaggcttcagaaagaaagttggtattgtatatatttgtatacacacatacatacatgcacacacacactgtccatgctacaaaacctaaacttgcacagtgttgtttataaaaaccaggactcagatttgaagtctcagatttggaaggaactttaaaggttacccagtccagcctccctcttcctcctaatgatttagtatcttcaccaataggttattttacctctgctttcacatccttagtgatggcaaattcatgcctctccttcccagagagcttatcccacttttggatacagagctctgactggcagaaagttcttcctaataatatgctgaagtctatctacctatagcttccacccactggttctaattctctcccttggggtaatattgaagaagtagagcaaatctcatctctctcctacatgaaatccctccagatatttgcaaacagctctcatgtttcccctgagtctttccttctagttaaccttccctagtttcttaaattctcactcttcttgttgctttactttaaatgagattgtgcatttgtatctcattcaaaatataggacctagaatgaaacataaaatcctacttctgatatgtttggactggcaagaatggagcatccaggactgtcatcgtctttattccaaatattgactggaataatgatgatgctgatgcattgcttatttaatgacatcagatccatatatgtctgctaggaactatgaagtggcactataggaaccactgaacttcttctctgttcaagaagcatgagccagaagcattccaaaaagcattagcttctcttacgctctgcctcacacctctgcaagtttctggaaagggtaaacattatacatagttaaagaatactaggactgcctgtaggacaaaggaagtcatggcattttcattagccacttattgctagctgcattacttgttaaaggaaatactggtgttctcatgggttcttttctgtgcatacacaaagatgtatagttgctacaaagcaagtggagcagggggacaccaaagagatatgctccatcttctttgttcacctctgctacatggaggagataggatttattgctttctttgagaaagagattggccagtttccttcctcccccttcttctggtggatcattccagaagaatattgcatctcatcatagttatctcctaataaagtaaaagtaaatgaaggagagctggagacagagaatcagctgagatgtgctggaaatactcggctgggcgcrgtggctcgtgccttgtaatcccatcactttgggaggccgaggcgggtggatcacctgaggtcaggagttcaagaccaacctggccaacatgatgaaaccctgtctctactaaaaatacaaaaaattagccaggcttggtgacaggcacctctcatcccagctactcaggaggctgaggcaggagaatcgctggaacccgcgaggcagaggttgcagtgagccaacatcatgccactgcactccagcctgagcaaccagagtgaaactccgtctcaaaacaaagtaacaacaacaacaaaaaaaacttgttaatgagagagtggctgatcagtggcacatcacagatgaatcctctgtctcctgcctccctgtagcttgtccttccatcaccacagtgagtagatgttctgctcacagcttttccattttgatttctctgcatattggcatagtattatgatttatctaaaactgagagttctgtcttttcttattgaattttcagaagtatgtttgatgcatcttttttctgttttccagtttccatttctaggggaagtattcttctcttcctgttctttgaaatacttaacacaatatctggcatgtagtaaacacttaaaatgataattatatattaataatttgactgttattactatacaggtgataatttgtaactaagtttttaattgtatcttaatatatgaagaattctacttttccttgcttcaaggggtggcctgttgtgattgttttattacattttgaaaggatactaccatagccttacagattcttctactacctattatacttctttcaacgacttccagaaatacggagtcattacattctccagatctgcactatgcaatgagtagccacaaccatgtatgtctaattaaatgtaaatttaataaaaattaaatacaattaaaaatgcactcagtttgcactagctacatttcaagtcctaaatagccacatgtggctagtggctacccattggacaacaggaatattgaacatttccatcattgcattaaattttgagaggctgaggctggcagattcttgaggtcaggagttcgagaccagcctggccaacatggtgaaaccccatctctactaaaaatacaaaaattagccaagcatggcggcacatgcctataatcccagctactctggaggcactgctttggatattcgtagtctatgctcttgtgctcttttcttagaaattgaagaggatatattttctagggtgttcctaagactaatctcttaatgtttcagggctctgaacatgcattttgaggattcacgttactgttcttattccagccccttagtgccattactatcttttggaataaatacaagaactttcacatcctccaagaagattatactaccataaattttattttgtttatttttatttatttatttattttgagacagtgtttctgttgcccaggctggagtgcagtggtatgaccatagctcactgcagccttgacctcctgagctcaggtgatcctcctgccttaacctcccaagtagctggaactataggtgcacacaccaccacacctggctaatttttatattttttttttttttgtagagatggggtttcaccatgtttctgagtctcaaactcctagagatgggggtctcactgtgttgtccaggctggtctcgaactcttgagttcaggcgattcccccctacttcagcctcctaaaatactgggattacaggtggtcctcctgccttaacctctttacaggtgtgagccaccacacccagccattaagcactttcaaagccattttttcatttgttatttacagcagcccagtgaagcaagtagcattgggattattattcccattttactaataagaaaactgagattcagttaagttacagcctgaagtctttttgttttttggggtttttttttttttttttgaccaagtctcactctgtcgcctaggttggagtgcagtggcatgatctcagctcactgcaacctccgcctcctgggttcaagtgattctgatgcctcagcctctcgagtagccgggattacaagcatgtgccaccatgcttggctaatttttgtatttttagtagagatggggtttcgccatgttggccaggctggtctcgaactcctgacctcaagcatccgtcagcctcagcctttcaaagtgctgggactacagacgtgagccaccrtgtctggccatgttacctgcctaacgtcttaaagggaaaataaacattaaggcaaaatagaggagattcagatcagggtaaaattttaacgtcaaattcagcattttttgttttgtttttactttgtttttgttctactttactcccactccgactgtaataaaagagtgaaagttctttaggggaactgaggtactcccaaagaattgctacagtcccatttgtcctgtgatcatgtgcttggggtgccataacagaataccacagactgagtggcttaaacaatagaaatttatatcctcaaagttctgggggctggaagttcagtgtcaggatgctagcggcagaggctagagatgaggtctttctccttagcttatagatgacaccttctctctgagtcctcatgtagcatttttctctatgtgagagaaagagatatctctcatgtctcatccttttgttttaaagaaaccaattatatcagattagggtctcacctgtatgactttatttaaccttaattacctccttaaatgccctgtctccaaatgtagtcacattgggggttagggctttaacgtatgaatttgggggagacacagttcagcccataacaccatgttaatgggtttttagtgtcttttgatattctggcttaacctggttagctggaaactaaatttagtatttgaatgggaccaaatgtagcaaatatctgtattctttatttctgtgaatatagaggcttaattaaattcaacctgtggtacttgctgtaaggtactttgcaactccaagatattctaatagcaaaaaatctgtatctaaatttcctacttttcttataatgtagcctaattgttaataattagagatctcagtactttacaggtaataaatgttcttytccttcctccccacctaccttttttacagatggagaaattagcatacaaagaaactgacttgtcagaagtcagagcaaggtattggtggatccagggataaatcccaaacttcttaacccctagaccggtttttagtccattgactatgcagcctaatggtaagtatctttttaccctatcgtggaggtaagagggattaagagacctagcaaggactggctttaaggaattcctcacgaataattagactactcgttatccttttctttatagccatgatgtcatttttgtcattggcatgaattttccagattgggagaggaggtctgaagttttgctttttaaatacttaaaaatatttctcggtggctcatgcctgtaattccaacactctgggaagccaaggtgggcggatcacctgaagtcaggagttcgagaccaacatggagaaaccccatttctactaaaaatacaaaactggtgggcatggtggcgcatgcctgtaatcccagctacttgggaggctgagacaggagaattgcttgaacccgggaggcggaggttgctgtaagccgagatctcaccattgcactccagcctgggcaacaagagcaaaactccatctcaaaaaaaaaaaaaaaatctgtaacaatttggctacatgagaaataattattgagaaaggaaactattatttaatgaatttgtccactgtgtccagcagaaatacaatgcaagccacttatgtagtttaaagttttgtagtagccacatttagaaaggtaaaaagaagaaggggcatgggagctcacacctgtaatcccggcatttggggaggctaaagtgggccaattgcttgagcccaggaattggagaccagcctgggcaacatggcaaaaccccatctctacaaagaatacggaagagtagccagtcgtggtggtgtgagcctgtagttccagctactagggaggttataacactttatcacacttatgtaactctctgtcttctagactaagagagggtgccttgttgttttttttaatccttattacctagcacagggctggaacttaggtagtcaatgaatttttcgtttgaagcatgaataaatgcagtttcagtatggaaatatcaaagattttaagagtgttattttgaaaatagtaagttggaaatggaatttaaatgtcaaattgaacaagatttaagaggaagctactctctttaaacccataatattgcattcattgattcattgtattgacctagatatgtgagatagtaaggagaataagacataatctttactgacaaatagttcataattaagatatacatgtgatcaaacacaaatacacacataagatatagatagttgctactataatatctcagctcccataatattgtttgatgcttagtgaaagaatttcaaggctgaatagggtcttagaagtttatctagttatctccctttacaacctgtgaattttctctcagcttggaaaagtttcagcatctttggtgaaaagtggtcattcagcctttctgcttgtacattttagtgtataaccaatcctccacaggacaattctcattgccagaaagtctctctctgacatctgcttccctgtagtgaatgctttgtcgaatgcctccaatcaaaagactacattttgtgaaatccctgctgagcattccagtagcatgtaagctagaacargggtcttttatctgatttgtttagtgatatatctccagtgcctagaataatgactgacaaacagtggtaataaatatttgttgaatgaatgaatctaaacataagcaggatttagagcattatttcaattcagttttttaattgtcagatttactccctttgtggactattacatatctttcattgctgtttcctgatcagttctttgcctgtatggcatagtttaacttattgagccctacattcttcatttgtaaaaagttattaataatacctgagatggaatatatgaaaatgcctggcactcggcctggtatatatagtaatggtaagtattagttgaatctgaaatggaatcagtgcagcaacctctgagcctcccctgaccctgacatcccaggaatgcaagtttattttttaaaattaattaatttcaagaagtatacataacacagaatttaccattttaataatattttagtgtacagttcagtgacactaaagacattcacattgttgtgcacccatcaccaccatcaatctctagaacttttttcatcttgcagaactgaaactgtacccattaaaaatggtaagttcatttttaatgttagcttaggtaaagcatgactgaactggtaaatctgtagtagaaaaaataatacattctaaaactaaatataaatgacatattatctgcagttttaaatgatctgttttcagttattgtttattaatatgaataattgatatcttaccatgtgacttctaggtatcattctctatgtcacagttgttttgatgaatgtgcattgaaatactgactttttaatatgggtaatttttctctcattgcataactttctgcatttagtaaaaagacaacttttttttttcttttgactgcttgctgtgtgccaaactctaggaatactgattggcttaagattatttagctctgacactgacaggcataaatgtaggaggtggcactactactttgcttagggctgtcaccagaaagctgttacaaaataatatttgtcctggactgtgaggaataaataggaatttcccaaatagagaaaaggggaaggtccagaggtatgaaagagtatgagtttggatgcagtttacagttgtatgagcttggaaagagtatatgtttggatacagtttagggattgatccttgaagagttttaaatggggtagtgacatgttttatcttatttgtattttagaaaaataatgctgatgtatgattggaaggcagtgagaacaaaggaattaaataactgtttttattggtcaacgtgagagataatgaaatcctaaactctgaatggggcaggggagattaaagagagatggttattttagagatacaactgacggaattggataaccagttggatttggaggacaagagggattacaggtttctgatttgttatgttaactggaatagggactgccagagaagaaagatataaactgattattaaatagtacctatgtattataatatactctgaaacatggccattattcttagaacactttgaaaaaatgataggtgactagctccttttttaatgtgtagaattctatcagatgctgtattctctttattttgggacagttgcctgattcagggacagttacctgattcactgagtagtttatggcagtacttaaaaattacacattttgtaatgcatttgtttctttttctttagtgctgctttccatgtttcagtagtttgtaccaagagtctatttcttcctagaagttcctttttcattgttttttttgtttttgtctttttttgtttttaagacagagtcttgctctgttccccaggctggagtgcaatgacgtaatcctggctcactgcagcttggacttcctgggctcaagcaatcctcccatcgcagccccttgagtagctgaaatcacaggttccacacctagctaattttttaatttttttgtagagacgaggtctcactgtgttgctgagactgttctcgaactcctgggctcaatgaatcttcctgccttggcctcccaaagtactgggataayaggcatgggccaccgaactttttgaactatttgatgcctttctgcccttaactgttattttgttcattttgctgcataattgagtatggattttgttttcttttttattattatactttaagttttagggtgtatgtgcacaacgtgcaggttagttacatatgtatacatgtgccatgttggtgtgctgcacccattaactcgtcattcaacattaggtatatctcctaatgctatccctcccctctccccgcatcccacaacaggccccggtgtgtgatgttccccttcctgtgtccatgtgttctcattgttcaattcccacctatgagtgagaacatgcggtgtttggttttttgtccttgcgatagtttgttgaggatgatggtttccagcttcatccatgtccctacaaaggacatgaactcatcattttttatgactgcatagtattccatggtgtataygtgccacattttcttaatccagtctatcattgatggacatttgggttggttccaagtctttgctattgtgaatagtgccgcaataaacatacgtgtgcatgtgtctttatagcagcaygatttataatcctttgggtatatgcccagtaatgggattgctgggtcaaatggtatttctagttctagatccctgaggaatcgccacactgacttccacaagggttgaactagtttacagtcccaccaacagtgtaaaagtgttcctatttctccacatccgctccagcacctgttgtttcctgactttttaatgattgctattctaactggtgtgagatggtatctcattgtggttttgatttgcatttttctgatggccagtgatgatgagcatttyttcatgtgtctgttggctgcataaatgtcttcttttgagaagtgtctgttcatatccttggcccactttttgatggggttgtgtgtttttttcttgtaaatttgtttgagttcattgttgattctggatactaaccctttgtgagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctagcccatgcctgtgtcccgaatggtattgcctaggttttcttctagggtttttatgggtttaggtctaacatttaagtctttaatccatcttgaattaatttttgtataaggtgtaaggaagggatccagtttcagctttctacatatggctagccagttttcccagcaccatttattaaatagggaatcgtttccccatttcttatttttgtcagatttgccaaagatcagatggttgtagatatgcggcgttatttctgagggctctattctgttccattggtctatatctctgttttggtatcactaccatgctgttttggttactgtagccttgtagtatagtttgaagtcaggtagcgtgatgcctctagctttgttcttttggcttaggattgacttggcaatgtgggctcttttttggttccatgtgaactttaaagtagttttttccaattctgtggagaaagtcattggtagcttgttggggatggcattgaatctataaattaccttgggcagtatggccattttcatgatattgattcttcctacccatgagcatggaatgttcttccatttgtttgtgtcctcttttatttccttgagcagtggtttgtagttctccttaaagagctccttcacgtcccttgtaagttggattcctaggtattttattctctttgaagcaattgtgaatgggagttcactcatgatttggctctctgtttgtctgttattggtgtataagaatgcttktgatttttgcacatcgattttctatcctgagactttgctgaagttgcctatcagcttaacgatggggttttctagatatacaatcatgtcctctgcaaacagggacaatttgacttcctcttttcctaattgaataccctttatttccttctcctgtctgattgccctggccagaacttccaacactatgttgaataggagtggtaagagagggcatccctgtcttgtgccagttttcaaagggaatgcttccagtgttggcccattcagtatgatattggctgtgggtttgtcatagatagctcttactattttgagatatgtcccatcaatacctaatttattgagagtttttagcatgaagkgttgttgaattttgtcaaaggccttttctgcatctattgagataatcatatggtttttgtcgttggttctgtttatatgctggattacatttattgatttgcatatgttgaaccagccttgcatcccagggatgaagcccacttgatcatggtggataagctttttgatgtgctgctggattcggtttgccagtgttttattgaggatttttgcatcaatgttcatcaaggatattggtctaaaattctctttttttgttgtgtctctgccagactttggtatcaggatgatgctggcctcataaaatgagttagggaggattccttctttttctgttgattggaatagtttcagaaggaatggtaccaggtcctccttgtacatctggtagaattcggctgtgaatccatctggtccaggactttttttcgttggtaagctattaattatcgcctcaatttcagagcctgttattggtctattcagagattcaacttcttcctggtttagtcttgggagggtgtatgtgtcgaggaatttatccatttcttctagatwtyctagtttatttgcgtagaggtgtttatagtattctctgatggtagtttgtgtttctgcaggattggtggtgatatcccctttatcattttttattgcatctatttgattcttctctcttttcttattagtcttgctagcggtctatcaattttgttgatcttttcaaaaaaccagctcctggattcattgattttttggaagggttttttgtgtctctatttccttcagttctgctctgatgttagttatttyttgccttctgctaacttttgaatgtgtttgctcttgctttctctagttcttttaattttggatctttcctgctttctcttgtgagcatttagtgctgtaaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttcttgtttgattgcactgtggtctgagagacagtttgttataatttctgatcttttacatttgctgaggagtgctttacttctaactatgtggtcaattttggaataagtgtggtgtggtgctgagaagaacgtatattctgttgatttggggtggggagttctgcagatgtctgttaggtctgcttggtgcagagctgagctcaattcctggatatccttgttaactttctgtcttgttgatctgtctamtgttgacagtggggtgttaaagtctcccattattattgtgtgggagtctaagtctctttgtaggtctctaaggacttgctttatgaatctgggtgctcctgtattgggtgcatatatgtttaggatagttagctcttcttgttgaattgaaccctttactattatgtaatggccttctttgtctcttttgatctttgttggtttaaagtctgttttatcagagactaggattgcaaccactgcctttttttgtttttcatttgctcagtagatcttcctccatccctttattttgagcctatgtgtgtctctgcatgtgagatgggtctcctgaatacagcacactgatgggtcttgactatccaatttgccagtctgtgtcttttacttggagcatttagcccatttacatttaaggttaatattgttatgtgtgaatttgatcctgtcattatgatgttagctggttattttgctygttagttgatgcagtttcttcctagcctcgatggtctttacagtttggcatgtttttgcagtggctggtaccagttgttcctttccgtgtttagtgcttccttcaggagctcttttagggcagtcctggtggtgacaaaatctctcagcatttgcttgtctgtaaaggattttatttctccttcacttatgaagcttagtttggctggatatgaaattctgcgttgaaaattcttttctttaagaatgttgaatattggtccctgctctcttctggcttgtggagtttctgccgagagaacagctgttagtctgatgggcttccctttgtgggtaacccaacctttctctctggctgccattaacaatttttccttcatttcaactttggtgaatctgacaattatgtgtcttggagttgctcttctcgaggagtatgtttgtggcattctctgtatttcctgaatttgaatgttggcctgccttgctaattggggaagttctcctggataatatcctgaagagtgttttccaacttggttccattctccccatcactttyaggtacaccaatcagacgtagatttggtcttttcacatagtcccatatttcttggaggctgtgttcgtttctttttattcttttttctctaaacttctcttctcacttcatttcattcatttgatcttccatcactggtaccctttcttccagttgatcaaatcggctactgaggcttgtgcattcgtcacgtagttctcatgccatggttttcagctccatcaggtcctttaaggacttctctgcattggtaattctagttagccattcatctaatttttttcaaggtttttagcttctttgccatgggttcgaacttcctcctttagctcggagtcgtttgatcgtctgaagccttcttctctcaactcatcaaagtcattctctgtccagctttgttccattgctggtggggagctgtgttcctttggaggaggagaggcgctctgatttttagagtttccagtttttctgctctgttttttccccatctttgtggttttatctacctttagtctttgatgatggtgacgtacagatggggttttggtgtggatgtcctttctgtttgttagttttccttctaacagtcaggaccctcagctgcaggtctatcggagtttgctggaggtccactccagaccctgtttgcctgggtatcagcagcggaggctgcagaacagcggatattggtgaacagcaaatgttgctgcctgatcgttcctctggaagttttgtctcagagsgccgtgtgaggtgtcagtctgcccctactggggggtgcctcccagttaggctacttgggggtcagggacccacttgaggaggcagtctgtccattctcagatttccatctgtgagctgggagaaccactactctcttcaaagctgtcagacggacatttaagtctgcagaggattctgctgccttttgtttggctatgccctgccctgagaggtggagtctacagaggcaggcaggcctccttgagctgcggtaggctccacccagttcgagcttcctggccactttttttacttactcaagcctcagcaatggcgggcgcccctcccccagcctcgctgccaccttgcagtttgatctcagactgctgtgctagcaatgagcgaggctccgtgggcataggaccctccgagccaggcgcgggatataatctcctggtgtgccgtttgctaagaccattggaaaagcgcagtattaggatgggagtgacccgattttccaggtgccgtctgtcacccctttctttgactaggaaagggaattccctgaccccttgcacttcccaggtgaggcgatgcctcgccctgcttcggctcatgctcagtgcgctgcacccactgtcttgcacccactgtccgacactcccctgtgagatgaacccggtacctcagttggaaatgcagaaatcaccggtcttctgtgtcgctcatgctgggagctgtagactggagctgttcctattcggccatcttggtgccaccccccggattttgttttctttactggaatacttcctcttttctcctctttctttccttttttttttttgttttttttttgttttttttggttttttttttgagacaagtcttgctctgttgcccaggctagactaatttttctaaattgcattggttgcttttgaatattgttttactgttgatctttcagcctggtttctatttgttgtggcttccttgaaccaattttgtgtatactggtagctcacctttacttaagcaatagaatactaaaaactagtatataaatggaatatatattgtatatttaatttttaagaatatatgttttctaattatgaaaatttttaaacataaaattaatcatgatcccctaatatatttgtcagtaattttaaagcctaatctagtttttaatctttactgatgattcagaggaaaacaagcatagcaggctactagaaagacaggggatgtaaaaaccaggagagaaggcaaacacttggagtgggacactggccaatgttgctgcaatgtaatagaaaagggagaagtcataacacataagatagagaggtggcatgagtccaatcccatatggctttgtaaagcrcccttaattgagtatgaagctattggaggtccttcaggagagaaatgaccttatctgttttatgttttaaaatactcactctgacctagtattagggttctcccccaaaacagaaacaatgggagctgtgtaggtaggtaaagagagagatttattgtggaaattggctcacaggattatagaggctgagaaatcccatgatatactatctgtaagctggtgccataatttagtctaagtccaaagacctgagaatcagggagctgatggtgtaactcctccttcaatgccaaagacctgaaaaccagtggggaaggcagagggtactggaggctcaagaactaggagctccagtgtccaagggcaggagaagatggatgtcctagctcaagaaacgagataattcactcttccttcacctttttgtgctatttggaccctcagtggattgrwtaatgcccacacacattggtgagggcaatctttactcagtctactgattcaaatgttaatctcttcaataaataccaccacagatacactcagaaataatgtttaccagctatttgggcgtcccttagcccagttaagttgacacataaagttaaccatcacaagtactcgttttcaactcggcatcygtatgtatttccttaagccatacttgatctccaaatgaagacagtaacaaggtcattattctacctaacataaacagctatcctgcatacaacaaaaaacacactagccccttccccaggggagtgaagttcttcagtgatgtttactcttctcctgatagcctgtaacttaaatattatgatgtaaaattaacaatacttaaatattratataaagtcaatacaacttttgttacatgataagaaaataagacaggaaagaaagcaaagatatttgcttaatatgtgtgtatatacacacaaacattcataatgaaataaggagaaaatacttagaacaattacagttcttgtttctgtaactggtcacatggttattgctggtatttataacttatctattcaatttttttttcttgtttgccttctgcaagaacctcatgattctttacccagcagggtgacccaaaggtttggcccatttgtagttctgcctggattgcatttttgtagttatccattggccctaatcacaacgtggagtaatactgagaaacaccctaaggtatctcctgtactgtagacatactcttcaattcttccattgtggagtagtagttcagtttctccttgatagtccagatgaatcacctcagccaacaacaccacaactccctctttacctgttgactcagaggcacaaggagcccagagtagctgggtggcagtctttaaaaaaaaaaaaaaaaaaattggagacttttttggttttgtctgttattattttttaattgaaacataattgtacatatttattgggtacagtgtgatatttcaatacatgtacacaatatgtaatgatcaaattggtaattagtatatcaatcccttcaaacatttatcatttatttatgttgggagcattcagaaatatgctcttcttgctatttgaaaatacataataagttctcattaattatagtcactctatagtgctatagaacactataacttatttcttttatttagctgtacttttatatttgcccccctacctccccttccttccctttagtaaccactattctgtctactatgaggtcaacttttttagcttccacatatgaccaaaaacatgtggtatttctttstgtgcctggcttatttcattaacctgatgttctacaagctaatccatgttgccacaaattacaaaatttcattctttttatagctaaatagtatcccattgtttatatataccatattttctttatctatttatctaatgatggacactttggttgatcccatatcttgactattatgaatagtgctgcaatgaacatgggagtgcagataactcttygacatactgatttcctttcctatggatatatacccagtattggaattgctggatcatatggtagtattcttttcagatttttgaggaaccttcatcctgttttccataatagctgtactaatttacaataccaccaacagtgaataagagttctcctttctccacatttttgtcagcatttatttttgtctttttactagtagccactgtaactagggtaagatgatatttcattgtggttttgatttgcatttccctgatgattagtgatgttgagcatttttcatatacctgttagccatttctatgtcttcttttgagagatacttattcagctcattttgtttatgtttaaatcagattatttgttgttttgtgttttgggggggagttttttgttttttgctgttgtttgagctccctgcatgttctggatattaatcccttattggatkaatagcttacatatatttctcccattctgtactcttttccctctgttgattgtttcctttgctgtgcagaagctttttagtttgatataatctcgtgatgtctaattgtgtaattttgcttttgttgcctatgcttttgaagtcttctccataaaatctttgtgcagatcaatgtcttgaagcatttctcctacattttttttctagtagttttatagtttcaggccttcatttaagtcttgatctgtttttagttgatttttgtacatgatgagaggtagggatctagttttatttttctgcatatggatatccagttttcccagcactatttattgaggagactgtcccttccccagtgaatgctcttgatgcctttctcaaaaatcagttggctgtaaatacatggatttatttgtgggttctctattctgggttccattggtatatatgtgtgttcttatgccagtactgtggtgttttgtttaccttatctttgtaatatattttgaaatccagtaatgtgatgcctccagctttgttcttttttgctcaggtttgctttggctattcagagactttaatggttccgtacaaattttagggtttttttttctatttttgtgaagaatgtcattggtattttgatagggattgcattgaatctatagatgacttttggtagtatggtcattttaacaatattaagccttccaatccatgaacatgagatatatttctatttttttgtgtccttttccatttctttcatcaatgttctgtaatttcccttgtagagatctttcacctccttggataaatttatttgtaggtttttttttatagctattgtaaatgagattactttcttgatttcttttttactagttcattgttggttcagtgctactgatttttatatgttgattttatgtcctgcagctttcctgaatttgtttatcagttctaagaattttttggtacagcgtttttttttttttttttgagatggagtctcgctctgtcgcccaggctggagtgcagtagtatgaacatggctcactgcagccttaacctctcaaaagatcctcccacctcagcctccaagtagttgggaccacaggcatgtgcctccatcctggctaactttttgtattttttgtagagatggggtcttgccatgttgcccaggttggtcttgaagtcctgggctcaagtgatacttctgtctcaccctcccaaagtgctgggattacaggcgtgagccaccgcgcccagccatctttcctcttaatattgcttttgctgtatcccataggtttgggtatgttaygtttctattttcatttgtttcaagaaactttaaaattttctccttaatttcttcattgacccattggttattcagaaacatgtttaatttgtttctttttctacaattttgaaagttcctcttgttattggtttctatttttattccattgtggtctgaaatgatacttgatatgatttcagttctcttaaatttggtgagatttacttatggtctaatttggagaatgcttcatgtgcttatgaaaataatgtatattatacagctgttggatgacagtaaaagtactgtcacctagctggcactgtaactgcatcttttttttttttaatttttaatgtagacagggttttaccacaaggccattccatagttctgtcaagccagctgcttcaggatgatgcatgttaagatcattaattccatgagcataagcttattgccacacttctttgtgtggcttcttggtcagaagcagtgctgtctgtaatggtggataagggattttgtgagtctgcagttggtagttttgacagtagaattgcatgcagggaaggcaaatcaatatccagagtaaatgtctattccagctggacaaaatgctgtcccttccatgaaggaagcagtccattgtaatcaaccagccactgggtagctggctgatcaccctgggaaatagtgccatatcaggggctcaatgttgatctctgctactggcagattgggcactcagcagtggccatcgccagattggccttggtaagtggaagtctatgctgctgaacttatgcataatttctatgcaaataagtgatggaggtgccatttactgggttggggaagacaaaaagtaacaagatgacagaggatggccttctgttttagtcatgttaagtttttaatatctgattgataaccatgtagtgatggcctataggtagttgtttatgtgaatgtgtgtgggattctaagaatccagttctggaaatgtgaatttggaagtaatcttaatggtgtggtgagcagacacaccctatttgaatgaggagatagtatggggtagtgaggaggcaataactgtgaggtagcaataactgtgaagtagtgaggaggcaataactgcagataactcttaaattttcctgtgaaggagagcaaagaaatagagggatataataggagggatatgtgtgggattaagagaaggatatgaggttttgtttattttaggttttcattgataggaaataatagagcaataagaatgctggtggcaaatgacctattagaaaggaggtacttgatagtagggtcagcaatgtggcagaataggaaactcctgactctccctccacccatgaatgcaccaaataaatatctattcatggatcagttctctctcagagaaagtcagagactagttgaaagattcctacccatggggcaactgaggaaacatcctcatcgaatgggtaggaaaaactgaagcacgctagggccagaccccaccctgggcattgtgccataaaattgggaagggaagccccagcatccaacttctccccatggagaggagggttttaaccccacatatagcatcctaacttaagattcttcatggtctggctcttaattcaccaactctgggagcagaggggattagacatacgcaagtctttctagaccacaggaaaaaagccgcagttagatatgggcatttaagcacttcagagctttcatcccccaggagcaatacatagaagggacttaagaaatgaagctccctgtttgcccccaraaggagtttatgacacactattccagcagcttcttgtttgtttggcttctaactaacttacattgggggagtttaggggcagtcaaatattaacctgccaccagcctgggaagagtttgtccacacattgagtccctcagctttcacagcttccaccgagggtctacatcctaaaactctcagctctgggagaagaagggattggcctatgcagatctctagacctctgcaggaaaaaagcagcagatttatacgggtgcagaagcacatcgctggactttattccccaggagaagtgcagagaaggggcttaaaatgtagccccctgtttttccccagaagggatttatgacatactcttctggtgactacttgccagcctggcttccaactaacttgcattgaggaattaaaggggtagacaaatattaacctgacaccaccctgataggcgtatgtccacacaacgagtgtcccaacttttacagctgtctcccaaaggattatatcctaaacatcttagctctgggagccaaggggactaggcatagatgagtttttctagatcacagaacaatgggggtggctttaaataggtatacaaataccttcagaggttatacctcctctgagcagtgagcagtgcagaaaggaagtaggaacatgtaggtcccatttgttctccagaaggggcttatagcacacacttccagcagctacttggcagcctggcttctaatgaacttacattcgggagctgatgggaaaacaaacrgtagccctctagctaatctcagtgataaatccaaggctactcattcttcctggaaggagtttcgtcatgtctcaagtgccacaacttctataacttccacccaagggacaagctttgggagtcagtggagctttgcattcatgagtagccttagaccacagcaaacaaaaaggtggacgtacagtaggaccacttctacgagcttctcctcaggatcagagggtgcaacctgaatttgagtacaggtttttgccacagatcttctccttagcttagagcagacagagagtgggacataaatgctcaggctcagctgtgaagatagaaggaaatggaaaacccattcagcacctcaacatctccagctacatctagagattctggctcctactctacggtattgtgggggtattgatggaatgtggtacatcctaagctcgaggggaccatcaaaaaagagacagcagtctgaataaacacagagatwagagagcaccttaaaatttttggctggatggattggtgagatccttctcctacatgaggccagtctgacaagtctgggagaggttatattcttatgtaatgcatagaagctaacacaaaaatcaaagaacagagaatctattcccaaaaaaaaaaaaaaaaaaagacaaatctccacaagtgaaatagagatatgtgatttacctgacagagaatctaagataatggttataaagatgttcactgaagtcaaaagaacaatgaaataacaaactaagaactttgacaaagagatagaaagtataaaatagtaccaaatagacatcaaagatgtgaaaaatactgtaactgaactaaaaaaattcaatggaggtattcaacagcagattcaatgaagcagaagaaaggatcgatgaaatcaaagacaggtcactgaaaaaaatccaatctgagcaaaaagaaaaaagaatgaaaaggatagtttaaagatagtttatgagacctgtgggacaccatcaagtggacaacaaatgcattattgatatgtcagaaaaagaagaaataaaatatattcaaagaaattatgtcagaaaacttcccaagccttatgtcagaaaacttcccaagcctggggaaggagatagaaagccaaatccaggaagcccaaagaacaccaaataagatgaacccgaaaagatccacaccaaagcaagttataatcaaattctaagttagagagagttgaaaacagcaagggaaaagtgaattgtcatatgtaagggaaccaccctaaggccagcagtggatttcacagcagaaaccttacagatcagaagagagtaggatgatacattcaaaaccctgaaaggaaaaaaaaaaaaaaaaaaaacwctgccagcaaagcatactatacccagcaatcctgtctttcaaaaaacaaagggatgatcaagactttctcaaataaaaacagaatttatccccactagaccagccttacaagaaatgctaaagggaattcggaagagaacgttaatcagcaacgtgaaaacatgaaagtataaaactcactgaaagaggagatattacaactgacaacatagaaatacaaaggatcatgaaagactactatgaacagttataagccaacaaattggacaaccagaagaaatgaatacattgctagaaatatgtagcttaccaagactgaatcacaaagcagttggaaatctgaatagtccagttatgagtaatgagattcaatcagtaattaaaagtctccaatcaaaataaagcctaggacctaatggcatcatagccaaattgtaccagacacttaaagaagaaccaataccagtccttttcaaactcttccagaaagttgaagaggagggaattcttcaaaatttattttatgaggccagcagtaccttgataccaaagccagacaaagatacaacaagagaagaagactacatctcccttcatctgaatggtaagaagaaaaagaagactgcagaccaatctcactgatgaacatggatgcaaaaatcttcaacaaaatactaagaaaccatattccgtagtatattaaaaggatcattcaccatgattaagtgggatttgcccttgggatgtgatggaaatgaataaatgtgagtcaccatgtaacagaataaaggacaaaaatcacatgatcatctaaatagatggagaaaatgcatttgacaaaattcaacatcctttcatgatgaaaactctcaatatattagatatggaaggaatgttcctcaacacaataaaggccatatatgacaagctcatagctaacattgtactcagtggtaagaagttgaaggcttttcctataagacctagaacaagacaaggatgcccgctcttaccacttctgttcaacatagtaccagaagtcctagcccgagcaattaggcaagaaaaagaaataaaagacatccaaataggaaagagtgaaatgaaattgtctctgtttgctgacaacatgatcttacatattgaaaatctcaaagactgtaccaaaacaccatttgaattagacaaatccaggaaagttgcaggatacaaaatcaacttacaaaagtcagtacatttctatacactaacagtgaactttctgaaaaagaaattaagaaaacaatcccatttacaataccacttacttctaagtaaaatacttagaagaaaatttaaccaaggaagtgaaagatctatacactgagaactgtaagacactgatgaaggaaattaaggacatcacaaataagtggaaagatacccagtgtttatggatggaaagaattaatattgtgaaaatatttataccaccagaagaaatctacagatctaatgcaactgccatcaaaattctaatgtcattcttcacagaagtagaaaaaacaatgctaaaattaatgtgggggagacacaaaggatcccaaatagccaaacaatcttgaccaaaaagagcaaagctggagacatcacactactgtattgcaaaatttattacaaagctatagcaatcaaaaaagcatgatgctggcataaaaacagacaagtctaccaatgaaataggacagagagcccagaaataaacccatgcatctacagtcaattgctttttgacaggaacacacattgaggaaaggacaatctgttcaaaaggtggtattgggaaaactggatatccacatatagaagaatgaaagtggatctttatttcacccctcatatgagaatcaactcaaaatggaataaagacttgaaactatgaaactgaaactataaaactgctagaggtctggacagagatttctttgatatgaacccaaaagcataagcaataaaagcaaaaatagacaaatggaattgcattaaagtgaaaagctactgcatagaaaaggaaacaatgaaggaaagagacaacacacagattgggagaaaatatttgcaaatgatacactggagaagggactaatatccgaaatatactaggaactcaaactactcagcaacaagaaaacagccctgttaaaaataagcaaaggacttgaatagacatttttcaaaagaaaacatataaatgggccacagatatatkaaaaaagtccaacatctctaatcatcagagaaatgcaaatgaaaaccacagtgagataccctatagccaacaccttttaggttggctcttatcaaaaagatgaaagataaatgttggcaaggattacaagaaaaaggaacctttatacactgttacggatatcacaaattagtacagccattttgaaaaacaggatggaggttcctcaaaatactgaaaatagaattaccatatgatgcatcaatcccactactggctatatccccaaaggaaatgaaatcagtatgttgaagggtagcttcatctgcatgcccgtattcattgcagcactattcacagtagccaagatatgggaataacttaagtgtccatcaatatatgaatggatttaaaaatgtggtatatatacacaatggaatacattctgccttaaaaaagaggaaattctgtcatttttgacaacgtggatgaacctagaggatgtaatgttgaagtcagttacagaacgacaaatatcatataatctcacatgtagaatctaaacaaagtctaacttatagagaagtagagagtagaatggtgataaccagaggctgggaggggaggggtgagtatagaaaaaagggatacattggtcaacaggtagaaacttatagttagataggaggagtagttctggtgttctattgcagagcatgttgactgtagttaataataatgtattatgtatttcgaaatagctaaagagagaactttaaatgttctcaccacaaagaaattataaatatttaaagtaatggatatactaattgctatactctggtgtgatcattccacaatgtgtacgtatattgaaacatcactttataccccataaatatgtaaaattattgttggccaattacaaataaaagcaaaaaaaataaaggggatacttgcaaggtttttgagaggatgagagactctgggacctgcagctaaaatggagggttggcttttgataaaaacagagacacttcatccacagtaacaggagagaagtcagaaaaaatcatgaatgaataggtaatttattcaccagacatttaatgagcgcctgttactatactacttactggggattcaccactaaacaagatcaagtctctaccgtcgtgaaataagtggaagggtcttacccttatttctgttttctcaatgaatcctgaattaaagtcatcccctaagagtgaagttggggagagtatatttggagtttgaggagagagagaaagatacgaatttttttttttagaaattggaaaagtaaacatagtgtagaaatgtggtatgatttctgggtggtgtaaagtggcatttgagaattatagctatgagtttaaaatgagaccaattagcttgcatatgtttttcttcagcactagtgagctgctggggtaggcacagtataggttgatacgtgatttaaccagatttaggattgagcctttagtaggtacgtttgacaaaaaagagatgggaaggaggaattaagagtgtttgccagagaatgatgttaatgagggaccatggagtctgagctgggcaagaaattaagtaaagacatgataggtgattgatggtgagaaagtagtagagtcagtagatgaatctaaattttcaaccaaggaaaatatattctccttatatgagtaatgtatcctttttatggaaaatttgaaaatatataagattataaagtagaaagtgggtgcagtgtcagggaacccagtactaccacccaaagataaccagttgtttatatttgctgtgtttacttatatgtttttttctaatgataatttccgcagttgtctaagtttccagggctgctgtaacaaatatcatggactaggtggcttaaacaacagaaatttatttcctcacaattctgaaggctagaagtctaagatcaaggcattgattggcaaggttgatttctttcttctgaggcctcactccttagcttctgaggcttctccctctgttgattacatgatattttctctgtacctgtgtccaaaccttctcttcttatgataacaccagtcatgctgaattagcgaccaccttagtgacctcattttaacttaattatctctttgaagaccctttctccaaatattgtgggatcctaggggtgttgcttttctggccggaaacctgtggccagtggtgcctttgcctgagttttgcttgggcccactgggctcgttccactcacttggcctggcaggctgctcatgctatcagcctggatctcacgcctccaagagagactggagttaggcatggagtggtgaggagtgtgtatgaacgagcttggggcccatctactgcgcagtcagacacaccagctcctgccgcaaggtgggcagctccaggtgccagcatggatgccagctctctgtgaggctgcagctggaccaggcacaccacaagcagcttccctggctggcaccaaagaatgcagtagtscccaaaagcttggaggaaccacagggccggaaagagggagtcacagccctgactccggaagctcccaggtctgggcyccccaaasggctgcagctcttccctccttctctttgcccaaactgcagcaagcagggggcatatttcagcccttttggtgttacagcaactcttttagccacgccgttcagcagatcccgagttcttgtcctgcaaccaggaagaatgaggtacgcagacaagtggagggtgagcaagatgaagaggtgctgtattgagcaatggaacagctcagagaagactcacagtgccagggcgtcccagtgagtgttcagcccctagcaggaaggatagctcctctctgcaggtaggttttcccaacaagtgttcactcacttctcagcagagagggtggctcctctgcagctggtcatcccatcttctgcagttctctgcagaggcagagaggaggccctagagtgggtggctcctctctgcaagcaggttgtcacgtcatctctgcagctctcagcaaagaggaggccctagaatgggtggcttctttctgcaggcagattgttcagtcatatcttcgtcctctgctctgctctggggctgatcctggggcttttatggacctcagaggggaggaagtgtgtgcccattggtctatgggtggccataggcaggcctggaaaaggcaccacaagtccccactccagtctgcaggactggcagttcagcccccagccttcaggctctccctggcctgaaggtgggcctcaccagggatccgcccttttctgcttaggaacctatctgcctcctgctgccattcatagcatccagactccaccctgactttgctccaagatcagaacaggtgccaacagcagggagaagccaggcagggggagcaggcatttctgatcctgggagggaagaggggtcctggctggacccccaagagtgcaggggtacctgggtctgcagccacatttgggtggctgcagctgtgcccgtcacggcagggctcctgcctgttccatggagcaggaggtctgggtttgcagcctcggtttgggtggctgcagctgcacccaggatggcgggactcctgcctgctcccaggctcccaccggctccatggagcatgcattcccagctgtgcctccctgctgcagccggcatgatgacagcagctgctccagatggcccaccgctgccatcacaaatacagttacattctgcggtactgcggagtggggaccttagcatgaagttttggaggatacagttgagcccataactggggtgctgtttgtttttagtgttttaaataattgtgatcattccatgaatataatttttatccccatattttacctaataacataacataaccattttcccatttgttctttagccttttaaaaatttaacagcttcaaaatactttgtcaagtgtttgtattatcaaatcttaatcagtcttctattttgaacatttaggtgttcctttttttgttattgtaaacaatgccaaggctttttacataaaacctttttcttgtattttggagtatttttccttagcatagaatctcggaartggattactttattaaaaactgttaatacatactgccaaattggaaaagtatttaatcttatactttctttccacatgactatttttctctccctctgcagtgatagactggagtgatgttagaaaacacaaatatggtcacctatcagagtctgcatcccaatatcaaggtaagggggaaaaaactccgtttggtgtggaaaaattttactcggcatcttttcccataaaaccttcgttgttagaggtctgagtttacaaataactcaattgttatatcagaagcaaatattgcagtttacagaggtattggtcataagcaatatactttgttttagctggaaataggaaacctagattctgagtataggtaatcccaaattagcttcatagttttaggcacggttgcttagcctctctgggttttctatagtttgtataagtttaggcttgggaataggcaaaattgggtggtgtgcttccacaatgactactaagaatctcagtgtcttttaggatgagataactgaactagacaaatactcgatttcctattttaccccagaatttcaccttccatcatgttggtatgtttgtcttaatgacttatgctccaacatttttttctttactagaagctgctgacatcctggatctaggtaagctatttttcttgtgtttctgttaaataaggggaattggtaaaccagggattagattataaccagttttaaccaacgaggaaaagaattccacgtgtctctgtctcagaaaccagtgaatcctgtgctcttgtctgcctaattatcccatgtacttcatctcagctgtcacatcaagtcctgcttatcagtaggccacagaccaagctaacaagaagggagggaaggtggttaattacatggggtataggggagaacaggaactgaaccaaactggaaataccatcttaatttactgaatccagaactaaaacaaacccctgccatccataaatcagtgtttggtgggatttttccccmaaaaaaattacttgtaagataaattgaactgaaactaaacctaaacattttctaactttattgacaaataaaaactgaaatattaaaatattatcaagtaagaagtcagaccaataattgcatttggttttcctccctggttagtgtatttcaggactaagatttgagtaataaaactagttctaatacttctcaatcagagttcctgcataaacatcagtcttaacattttagaatcctttaaaatccttttatatgttacatagattttgatatccagatacctgtatcaatttttgttcaagtattttgatatattttgttacaacttgatatttatttagctctattattatcattgtctatttgcctcctcttgcctttctttcctgcaacatattactttccattgcccagtgacacagaagataacatgaagtagtagaacactagactaggagtcagaactcctaggctttttgagagccagttctgccacttagtaactttgtgactctgatccttagttttcttatttgtaaaatggggataataatcccattctgcctacttcacagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtaaaggtgcctggcacttgataaatgatagttattttttattattctttaaaactttcctcaagctttttaaggtactgatgtgtggtagaaaaaacatggacataggagtcagacaatttgaaccaaggttcaaattcctattcccacttaccarttttgtgacttcaggcaaattacttaatctttctaagcctatttcctcatctttaaaatgggagtaaaacctactttgcaggttataatgaacmcaggagataatggacgtagtctggcatggtacaggcaaatggaagacagtgatagctgctgttgtttttggttttgtcgctaatatgaatgataataacaattgtagctcagtgacagcttaaggcatattgtaaactgttgatggggagttgtgaaatgtgggtactcaatttaacatagagtatatcagttactaaaagatgttaaaatttgaaagtgtatttttcctagagcattggttgcataggcatatcctctgatgtaagttaatcctgcatatttcatttttaccatctagcataaggagcagctccaaatagcaaactgaaataaaattcagtagatctgtggaatctcaaagttggaaaagaccataaaataatctacccttgcccagcatttaaaactcaacattttgaattttttgtaaaatgtcttatcttgaactcctcaagtttttgaggacttagaacctcctcacgtaattcatttcatatttagacatatttattggtcaaaaatttgctctttttgtaatttctgttagtcatccctctgactttctggccatatgaaacagggttagcctatttttcacttactggccctgatttttagagagaarctctagggactgccttctcattgccactctgccgctttcatagttgaatctcacacctagattattaaaacagcttcctaactagtcttttttgcctccagccctatcaccctcctrcccattctttacactacagccagaatgacttcaccccaaacgcttgaagacttcctcttctcagtaatacagtatatttggctcgctaatgactgaacactgcctttatctgtaacctttttctaaactactttttctgtaaactccacccagcagccataccaaaagatctgcatttagaactgctttttctcatgtctgggcctttataatgcctttctttctgtctgaaacaaacaaaaagagtttcctttttctttgactcctgcttatccttttacactttagcttagaagcctagagctttctttggtaagtttccacaagcactctgggtgctcctgtagcaccctctgtctctccagtgtagcacttatcacattatcttagtggtgactgtttagtctctgtccctcactagattctctgtctgtcactagactgaagctctgtgaggttaaggatgatattttgattacagttatatgtccagcactcagcacagtgctttgacacacactataaatatttgttggatggatggggaatggctctgagacttcacttttttactcatgctaattgttcatgttccttcacctggtcctcaggtgatgtggttttgggtctgtttaccatcactaggtaatcatttaaactcagatttgctctctstcaaagtgtagttttcagaactatatcccaggtattattttattagtcyaagaaagaataggaatattacttgtgtgcttcttttcattcactcagaaactcatattgagcctctattaaatttcaggcactgtgttaaacagtaaagattttaaaaatgaatataagcccccatccataaagagcttacataaataattatggtgatatgatgtgaacaggatgttataggagatagggagatggtaaaatttgtccagcccttttctgcaaagccttctgacagaaaatgtaaaatttttgctgagctttagtcactgagtgtgagtaacatgggcaaagatatgggaccaagaaagccatgagttttaggaaacactaaggtcctttgtagcttgaatattgtgattctacatctgtgaagcctcccaaatccagacctttctcatatcaggatatctgcctggaccttcgaaaacacctctgatttctctgccttatctaaggctctctttctgttgcctgaaagtctgtgtcttttcagagggaccctgtggtatagtgaaaagaacactttctctagatgctttatttctattaagtaaaaattcttctagtgacttttccttaatctacaaagaactcctagaatctatgagaaaacaaaagaatatctcagcagaaaaatggctaaataaaatacagactggctgataagcctaaagagatctttgactttattagtaatcaaagaattgcaaataaaattataatagyattttattttttcactgataagatttgtcaaaattatggaaattgttaaaacacagttttagcaaatatgtggtaaacacacctgtgtactttcggtaggaatagaaattgagtctgggcaatatagtgagaccttgtctctactacaaagaaaaaaattagccaagcatagtggtgcacacctgtagtcccggctactctggagactgagcggggagggttgcttgagtccagatcggggttacagtgagatatgattgtgccaccacactccatcctgggtatctgagtgaggctttgtctcaaaaaaaaaaaaaaaaaaagttggcttatacttgtaatcccagcactttggkagtccgaggcaggaagatgacaagcctaggagtttgcaactagcctgggcaccatagggaaaccctgcctctaagaagaaaaatcagtatgttctttctagaggatatttcagcaatatatatgttgtatcaaaatctaaactatgcatgctctttgtccactaatcccacccttaggacaaatcccaaatctgtgtctcatgcctgtaatcccagcactttgggaggccgaggcagttagatcrcttgagctcaggagttcgagaacagcctgggcaatttggcatagccctgtctctacaaaaaatacaaaaattagctaggaatggtggcacacacctgtagtcccagctactagggaggctgagatgagaggatcgcttgagcccgggaggtcaaggctgcaattagctgtgttcacaccactgtactccagcctgacactgactcaaagcaagaccccgtctcaaaaaaaataaaataaagacacttaaattaccatcagtggcgtttaacaaatatattgttatttaaattttggtacatggaacactatttatacggtaatagtggagtggaatttctgatctaaagatgttgattatgcttaattgtttttaagaatttgggttcacatttaggttgaacaaagtagagttcttgtaaaggaatgtggccagaacagtagccagacatgagtagccagcctgtcaaattaggagcagttgagggatttgggacatagagattagatatatctaggaccagtagaggttagaaggcagatgttggctgactataaagagcggtctgtccatttgtactgttgagtaatagctaaatagctaaataatgagtgtcccatgactggaagtatttcagcagaggctggaaggaccattcaaatctcagctttttttttttttttttttttgagacggagtcttactctgtcacctaggctagagtgcagtggtgcgatcttagctcattgcaacctccacctcccgggttcaagcagttctcctgccttagcctcccaagtagctgggattataggtgcctgccaccacgcccagctaatttttgtatttcttttagtagagacgagrtttcatcatgttggccaggctggtcttgaactcctgacctcaggtgatctgcccgcctcrgcctcccaaagtgctgggattacaggagtgaacyactgcgcccggcccaaatgtcaacttttgtatcaccttatcaagatgtcttttttgactgccctggctaaaatagcacaccttctttacctcttacttttatttttttaaatttcaaaatagccaggaattgtataattaatctggtgtctctgttaccctctggaccagctgacgtatttgtttgtttgtttgtttgtttgkttttgctccatgtggagcaaaatattgtttgtttgtttgtttgtttgtttttgcyccatgtggagcaaaacattgtttgtttgtttgttgtaagctccatgtgggcaaactttggctgtattgtattttgctatatatcaccagtgcctagaaccaggcttaacatatactaggtatttagtaaatatttgctgaatgaatgaatattagagaaggtgattcatgcatttaactaggtgacctcttatgcccatattttatgggccaaggtactttaatgccatttttaagtctcttcagggcaggtacctttttttcttttttaataataaatgtaactatcacgtggtatgcatcagagtttataaaaacacttttataagcattatttactaaatgagatggctttttctcatctgtaaagtcttagcttagacatttcctctgaagagtatctgtccatgactttamtaagatagctcccagtctctatcacatcacctcattttattcccttcaagttcttttcacttactgccttgtttatttattgtttatgtgttagttgtgtctcatcatataccagcatgtaaatgagggcagggacccctgtcatattgcctggcacatagaggatagttaataagtatctgttgaatgaataattgaaaacattcaaattatactgtttgaatattttgaattataatgttggaataattgaaaacactcacattatatatgtttaaattataaaacattatacctatgttagttaataatattaatcttcgyaataatctctgagcccaaggatgaatgagattttcatgttctgcaatctcaagacaacctgtactacctcgtaaactttatcattatcataacagattatttgtgttatgtttattaatgtctctgtttatctctagactgaaagctccatgaattgagaaatcatgtcttaccttgttcccctaacatttaacacagttctttgtacttggagaagtttaaatatttattgaatgaagaatctatatacaatcttgtaagacagatattgtcttcatctttcacatgagtaaacttaggcttggaaggattaagtaatttacccaagatagttagctgtagaaacaagacttttaccaacatcttcagactcccaatattacattatttaaactacaccagtagtagttcttagtcacagatgttaatccaaattacctagggagccttggaaaatacatattctcaggccacacttggagcctactgaatragaacttctgaaggtgaggcccagaactttgtttaaagaaatgagactataagtatcacttgagagtcaatgatttataccagaggtctggcaaactactattgggaggtcaaatccagccctctgcctgtttgtgtaaataaagtttgagtggaacagccatgctaatttaggcacacatactgtctgtggctgctttcacactggagtggtggagctgagtagctatgacatagactgtatggcctagaaagcataaaatttttattatattgtccttaacagaagacttgctaactctggatctataccttggtgcctgtcctatttcttttgtggttactttagtgcttggagatatggcagaatattatgtctggcttcatcatgggcattacaataggtgtccaaacattcttactaagtcataaaaattatcttattttgcaattcacctgataataaggaactaagccttaggtagcccaagaagtcaaataaaaggaaaataccatctaggtatggttcaagccagtcagccatcacagtgggtgaactactttaaacagaggttccttttcatccagttagtgatagagtgtttcctaagtggtaaaagggctgaggtttctagcctgtgtacattacagaatagggattgattaccatggttgatatgtataatggagaactgtaattaataccctaattgttgtggtacccctgatgctgccattattcttaagaccaaagtctctttggtgcttttagtcagaacttaagctaatataagcagttacccaggactgaccaaaactcttgatctgtgcttcctaatacagtaactattagctatgtgtggggatttaaatttaagttaattaaaatttaaaaaatttagtttcttacgtacccacatttcaagtatccaatagttatgtggctagtggctaccttattggctagcacagatacagaacattttagtcagcacagaaagttttattggacagtgctgctctagatgccagagttgaagattctcaatccagggaaatccaaaacttactatttgatttaatctttcatttgtaaggatggaataataaattgtaatgttttatttttctaacagcaaacaatgatgaaatgtattcagtccttgctttagggccctgtcamctagaagcaaactcttcattaaattctgataacgcctttaaaccttgacttcagaaaatagtcatctcatttgccctatggactaactgtctagtcatgttgattaatcatcagctagttcatgaaatagttcagaactgactgtgatttctggccaaatctatttggcttagttaagggtagtgggaaaggaaccagttataaaacagaagctataaaataaatagagtgtaaagtcttggcatcatctttggagtgatttagatttcwtcattcagtgactcatttttattcccagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtgggtattagggggagactggtaattggtttaacctttaaataaagaacttgataatctttagtgatccaatgaggtctgtatcaaatgttcctgccttaagatgttttcccttcccccagcacagtgtcaccttgaagattgtttatctaggacagtgttcttcaaacttttagaggctgtaaggccagttcaagaggctaaaagattctacagactccccagcttgttcttatttactatcatcagacatgcttcccaggtcctactttgctctaaattaacagttctttgtcactttgcaccccagagcaacacagcggtggctaggatgggggtgcagcgggggtaggtgasagagagccagtttttagagtgaggattcaactataatctcactcatctggcttcccctcccctcaaatcatctcgccccttgtctctagacagccttttcttcattcttcctgagctgagatgctggaatccaaccatattgggtgttaaaagctgccacttgacagcggtgagggacctttccaagagtcagattgttcaaaaggaatctccccacccactttctgcctcttctattctgttttccattagcttcctggtcacttctttgaagtactagtatatcttgctttggcattttggatcactttaggaatgaacataaataacaccctaagccatctttagaccattattttaaaacgtgaatctaaaacatccgctcaggtcacttagattcttccccttaatactcctttgagctcaaacaggaaaaaaattatattttttatgctcaaaaccagtctacaaatagcttactgtttagtgtagattataccctgaaaacattttttttaggaagttgactgtgatatagatttctatttcctttacaggtcattttacctgggacaaatacctaaaagaaacatgttcagtcccagcgcctgtccattgcttcaagcaggtaattgattttcaacatctttagtaggtggaagataagtcatttttttatggtttttagacaatcaaaacaggaggtggaagcccttgggcttcttacctgagggccccagaataaacttctatgggaagaacacagctcaagaagtaaaatttggtcactgtgagttttggcagcagacattctttccaccttcatcccaagtaacacccttgcctccttctttacctccttgaggatattctgtgttactgaaaacaactgctaatttttactagagctcttaattcggacaggaaagagagttatagtccatagacattgttgaaaatggagcagtatttctttctctgtactcagcactcctgtcacaatcttatctttctacaagaatgttgacactgagtcccactgtgaagcatctcaggagctcatcagaggtcatccagagtttcccagaaggattaagtaacccagacaatgcacagatggtattgactgtgtcagtgtttgatatggctgataagcaaagaagtgtttggtgctaaacaaagttaaacgtcaggaagttacctacaatcctttcctttagtactcaagggttatttcctcaaactgtcaacatttcaggttgagtttgaattttgtctgttttcttttttttttttttttttttttgagatggtgtctcactctgtcgcccagactggagtgcagtggcgcaatctcggcttaatgcaagctccgcctcctgggtacataccattctcctgcctcagcctcccgagtagctgggactacaggcacctgccaccatgcccggctaatttttttgtatttttaatagagacggggtttcaccgtgttagccaggatggtctcgatctcctgacctcatgatctgcccgcctcggcctcccaaagtgctgggattacaagcatgagccaccgtgcccggccatagaattttgtctgttttctaagtagaaatacaagttcaggacttctgctcatttgaaataaaagggactgaatttatacttccacctgaaacaatttatttaaaaagacaacatatgttaataatggtttgttttgttttgytttgttttgagacagagtctcgctctgtcacccaggctggagtgcggtgtcttgatcttggctcactgcaacttctgcctcccggcttcaggtgattctcctgcctcagcctcccgagtagctgggactacaggtgcacaccaacatgcctggctaatttttgtacttttagtagagacagggtctcattatgttggccaggctggtctccagctcctgatttcaggtgatccacccaccttggcctcccaaagtggtgggattacaggtgtgagccaccgggcctagccaacaatggtttttaagtcactaaaaatcaagcagccaaacagtgatctctgagagagagaaaacaaatgagttgagctacctctatgattttctagcttactgtcttaacagtttccagaccatggcccagggaaagggaactcatgttgagcccagcagactccctaattggaggaaatggaagaaaaaaaaaatgtgagtccagagaaaccaaggtggctagaatttttaggacagagtgtcaggaggagaaagctgcacacaaagaaaaccacagtgatcttcagagggtccaggaaaagactaccattttataaatgcatatgagaaaactacctaaggccaaaggaaaaaactatctgaaaggattcaaaggaatagaacctggcactcacacagggctgagaatagttcctgatctcaccagctagactagaacatctcataattgattgggcactgggtatgatactcaggaaggtgttgctcatattggaaaataattaaccttagcctgagtattgcttcagtccrgcctgacaaatcataaaggtaaaactcaagaagatcaaactacttcacaaataacttaactgcatcgaggaacaaagcccaagaagatttataggaatgcaagaatatccagtacccatcaggtaaaattcaccagatctaactttcaatcaaagactaccaggcatgcaaagaggcaggaaaatgcaaccaataatctagagaataattgattgaaactgactcagactctatacagatcatagaatagcagacaaacacattaaaataattattttaatatatttgttatattcagatattaagcagagacatggaagatattaaaaagactcactgggctactatgtgggaaatgaaaaatacactagattggattaatgccagaagaaattagtaaacttgaaaacataacaatagaaactattcaaaatgaaacacaaagagaaaaaggaatttagaacctgtgaactatgggttaacttcaggtgaccaaatagacgtgtaattggagtcccagaggagagaagtgrtgggggatagaaaaaatatttgaagaaataatggctaaaatttttccaaaattaaaaataacagctgggcatggtgtctcaggcctgtaatcccagcaatttaggaggctgaggtgggcggatcgtgaagtcaggagattaagaccatcctggctaacacggtgaaaccccatctctgctaaaaatacaaaaaaattagccgggcatggtgaagggcacctgtagtcccagctactggggaggctgaggcaggagaattttatgaacctgggaggcggagcttgcagtgagctgagatcatgccactgcactgcagcctgggcgacagagcgagactgtgtctcaaaataaataagtaaataaataaataaaactataggtccacagaatcaagaaattcaaggaatcccaaagataatagaagaaaactactcagaggcatatcataatcaaattgcacaaaaccattgatagagaaaactcaacagcagccagagaaaaaagacactttatatataggataactaatgtaagaattatatttcttgtcagaaacaatataagcaagcacaaaattgaacaacaccttgaaagtactaaaagaaaaataaaaaacctgtcaacctggactactgcagccagcaaaaatgtctttcaaacacaaaggtgaaataaagatattttcagatttacaaaagctgaaggaattcattactcacagactcacacctcaagaaatgttaaaggaggttcatcaagcagaaagaaaatgatatcaaatgaaataacagatctatacaaagaaatgaaggtcactggaaattgtcattataaggatagatatataagatgttttcttatttaaatctgtgtaaaagataattgtgtagacaataaccgtatattgtgaggatgataacatataagtaaaatgkatgataagagtagcacaaaggcaggaagggaggaatcttaagtatactattacaaggttctcatgcatgaagtagtactatcttacttgataaggtagactgtggtaagttaaagatgtttgtactataaactctaatgyaamcactagaataatgggaaaaaatagcaaaatgttttatttaaacccagctatatcaataatcaaatgtaaatggtttaaatgttaaaaagcggaaattggcacattggataaaaagcaaaacccaattatatactgccttcaaaaacttacacttttttctgtttctttactatcgagcttgctatgattggaaaaattatgctttaaataggttaaaagtaaatgtatgaagatgatgtaccatgctgacattagctataataaagctgaaatggctatattaatatcaaagtacacttcaaataatattaacagggttaaggaagttaattttataatgataaagaaatcagacaaatcctgacatgaagcaaaaaccaatagaactattaggagaaatagataaatccaaaattatctatagtcagacttttaatactcctctctgtgtaataaaagaacaagtagagaaaaaaaatcagcaaatatatagtggatttgaacaacactatgaactaacttgacctaactgacatacatagaatactgtccaacatatgtagatacacattctttccaagtacctgcatttcacaaaattaaatgtccattactaaataaaaactctcaccaaactagaaatagaagggaactttctaaatcctaaactctaaagggcatttattaatagtctacaaagaatatcttacttaatggtgaaagactaaatgctttccccttaagatcaggaacaagacaaggatatctgctcttgccacttttattcagtattgtattaccaatgcaaatgggccagaaaaagaaataaaagggatctgggtcgaaagatttagaacaaacaccaaggaaaatgtatacagggcaaataagtacatgaatagagatgctcaataccattatttcattagggaaatacaaaataaaagtgattagtgagctatcactatacatttatttaaatggctctgattttcaaaagactgaccatattaaatagtggcaaagatgtagaacaaatggaactttcatatgctgctggtgaaaatgcagaatggttcaactactttgsgtggggtgggggaggaactaacaaatacgaaaaatttatataaagaaaaccttagaagatgcctgaccaaaattttgattcattaaaaaaatagagtggactttgtcaaaattaagaacttctgctcttcaaaagatactggtaagagaacaaaaatacaggtcacagactatgagagaatagttttgcattgcttaacgatagggatatgctctgagaaatgaattgttaagcaatttcatcgtcgtgtgaacatagaatatacttgcacaaacctggatgctatagcctactacacacctagaccatagcctattcttcctaggctacaaaactgtccagcatattactatactgaatactgtaggtagttgtaacacaatggtattcgtctatgtaaacatatctaaacatggaaaaggtacagtaaaaaaaaaaatatggtataaaaggtatattaaaacttgtacacccgtatcaggcacttaccttgaatggagcttggaggactggaaattgctctgggtgagtcagtgagtaagtggtgaactgcktaccactgtcaacgttataaacgctgtacacccaggctacactaaatttatttaaaaatttttcattcttcagtaaagagttaaccttagcttactgtaaatttttcgctttataaacttaattttttaacttttttgactcttataataatacttagcttgaaacacattgtacagctgtagaaaaataatttttaattttttttttttttaccttttaaactctttttgttaaaaaacttaagacattaccctaggcctacacagactcgggatcatcagtatcactgtcttccatttctacttctgagcctactggaaggtcttcagggacagttacatgcatggatggagctgtaatctcctatggtaacaatgccttcttctggaatacctcctaaaggagctgcctgaggctattttttagttaacttttattttcgtataaagaatacactctaaaataatgatttaaaatatatagtaaacacataaaccagtaacatagtcaattgttatcaagtattatgtactgtacataattgtatgtgctatacttttatacagctggcagcacagtaggtttttttacaccagcatcaccacaaatgtgagtaatgtgttgctctaggaccttaagacagctgcattataactaggatacaggaattttttagctccattgtagtcttatgggaccacaatctatacatagtctgtttttgaccagacatcattatgcagaacatgactatatttgcaaatcacataactgacagcattattttccaaattgatctgtagattcaacacaatctctgtcaaaatcccagctgccttttttgcagaaattgacaaattcattctaaaattcttacaagagacccagaatagccatagcaatcttgaaaagagagaacaaagctgaaggattcacatttcctgatttcaaaacttactacaaagctacagtacttaagacataatggttctggcaggaaaatagacatatagatccatgaattaaaattgagagtacagaaattgacccatcaatttatgatcgatcgatttttgacaagggtaccaagacagttcagtgggtttttcaacaactggtgcaggtacagctggttatccacataaaaaaaagtgaagttggactctacctctatgccatatacaaaaattaacttcaagtggatcatggacctaaatgtaagagttaaaactgcaaaactctttaaagaaaacatagaaggaaatcttcatgaccttggattagatawtataacaccaaaaacataaacaacaaaagaaaaaatagataatttaaacttcatcaaaattaaaagatttttgtttccacaccatcaggaaagtgaaaagaacaacccacacaatgggagaaaatatttgagaattatatatctggtaaaggacttgtatccagaatatagaaagaactcttaaaactcggaaattaaaagacaacatgattttaaaatggacaaagaatttgaatagatatttctccaaatatatacaaatgaccagttaggcacattaaagatactcagtagtcattagagaaatgctaatcaaaactgcaatgagatatacatcacattgactagatgactctaacatcaaaaagacaaacaatggcaagtgttggtgagaatgtgtagaaattggaacccttgtacattggtggtaaaattatgaaatcctatagctacttgagaagacagttcagaggttacccaaagtgttaaacagagttaccacatgacccagcagtttcactcataagtatatacgtaagagaatagaaaacatgtccacagaaaaatataccataaatgtttatcacatcattattcataatagccaaaaagaggaaacaacccaaatgtccatcagctgatgaatgagtaagcaaaatgtatatccatacaatggaatattgttcatcaatgaaaaggaatgaagtactgatacactcattgacatgggtgaaccttgaatccattttgctaaatgaaagaaactattcacatattggccacacattatataattccatctatatgaaatgtccagaataggtaaatccatggaaacagaaagtagattaatggtttctagggactgggctgagagggtaatggggaatgactccactggggcagggggttcattttgaggggattmtggaaatgttataaaawtagatagggatggtgtttacacaactctgagaatattctaaaaatcattgaattgtataccttaaaagggttaattttctgttttgtgatttaaacatatacctaccatgtgatccagccatttcactcctaggtatttgtgcaagaaaaaagaaagtgtatttccctacacaaaaatttgtacttaaatgtttctagcagctttatttgtaatcgccaagagctggaacaaaccaaatctccgtcagcatggttataccactcaacaataaaaggaaatgaattactaatatggatgaattatcagagtagttatgctgagtgaaagaagctagacaaaaaagaaagtacatcttctatgattccatctaagactagaaaacgcaaagcaatctacagtgatagaaagtagatcattggttgcctgggtgcagaggtcctggaggggccagaagaagagattacaaaagagcatgtgagagcttgaggataatggccatgttcattatttttatcgtggtgatactttcacaggtttatatggtgtatatagtaatatgagtatatacatatgtcaagacttactaaagtgtatagtttattgtatgtctattgtatgacttgattagtaagttgtcaaaataagaaaaaattaaccctcaatagtctgtgtggtagatatacacaccaatatactgaaatattccacaaagagacactaagaatatggtagtttaataggacgtagtagtcctaaaaagactaaaaagggattaaaagtccctacctggaagggtagggagttagagaattatagaatgagaaaacatttaattaactggcctatataagacattcttgtcctttttttaactggtatgggtctatttgatgcttcgttggaaagtaattttttccccttcatcttatctttcattgtttcttttgcatgaaaccattcttaattattagggaataattcagttggttgtccctggcccagctataaccaatctgaatccaaaacatgaattttggggttttactcttaatctgtctatacctcatgccttgtttttcccagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggtgagtaagtaaacccaaactctttctagccaattattaatagttagcgtccaaaaactgaacatcctattatgggaaagcctagggtacccagcttatcccttatttttcatatagtctcctaaaaaggcccacccaaaatgaaacaagctgcacaattyggacatctccatctctacattagcttatgatatccaggcttcttccaaattctttctaacaagaaatcacaccctttgttcttcttggccagtgcccatttacctgagagagagaatggaaggaggtcttgccgtttaacctatctcaaaaagcataaagctttcaccaaatcctatcataatgacaagaaatgagagaaaatctgccagtagaaagcatggctgttataaggatctcttatctcctttctcactaattctcacctggtccttggagttttctcgcttcgaatccattattacataaaaatcattttttaaaatttaagctaataacctcactaggtttttctttccagatcagattcccctccagcttttgcctcaataaatctgagggattcagcccttcttatcagttactgtcaatcactattacagtgagtctcaatgggggaccgagagagttagattatggactttgactatacttcctctcaggaagctgtgctaaattgagaattagagagcatgtatcatgggctccctaggtacttatttaacgttttcccccattaaaaaaaawtttgtaatgtaaaatttcaaacatataaaaaggtagagaaaaatagcatagtgaatgctcatgtaaccttcattgttgaagtcaatataattttatctatacttgtatacactttctgtccccacctccaattgttaaacatagcatgattttatcatgaaagtatttagtatgtctctgtcatgggcaaggatgtcttaaacataaccatacaattatcacatacaaataagccaatgataatgtcttaatatcaacaaatattttaatgtgtttaaattttctggattgtctgtctctgtctgtctctctcttttttaatcagttttttgaatcaatctaactagaatcctcacattgcagttagttgatatgtcctttaagcttctttaaatctacaagttcttatctgctctaatttttcttgcagtttatttgtttaaaaacctaagtcatttgtcttttaaatttyctaaaattatattttgttgattgtattcttgtggtatcattcaacatgtttctgtgtcctctagttcctaaaattggtagctaaatgtagagacttgatcagattctggttcaattttttcataagaatatttcatagctggtgatatttatttctatcaagaagcatgtatagtctggttgtctcttgttttataatgtaatataatgtagcagccattgctgctcatagtctagatcagggttgacatttttcttgacagatctgatagtgaatattttaggctttacagatcatacattctctgttataattacttagctttgtctttctgctaaggcagctgttgacaatacataaacaaacagggttgtgttctaataaaacttgatttacaaaaacaggttgtcagcctgccaactgtagtttgctgcccctgatttaaatctataattcatatggttacaaaatggaaaaatctaatcctgccattctgtctacataaattaatggaatacatctgttaacataaactttcatcaactatttagttattttgagatatagttcacacaggaaaaacagtttaaatgcatgctttatttctttatttaccaattttcaatgaattggtttattagcatcctccaaaaatatttaaggaggattttgttgttgttgcttagtatcatragctcaaaacttcatacatatttgttgtgtttcactccatcacaccaattgaccttattgatgcttgaattatcccatcttttgccagaaggaaacttgtcaagttgtctcctgactcttttatatactgtytgatactatttgatagctctcttggatttttgcaatttcaacatgttccaggttcatcttatatattttttgccccaaatatggaatcagctagttcttctaggttcctgggctccttttattgggaaatggtatttagagaccataatcagaacactagagtgctcagtgctactaggttggtcaccctttctagtctttttggtatagagaggcaggaactacctttttaaaaagattattggctgggtgcagtggctcacacctgtaatcccagcactttgggaggccgaggcgggcagatcgcaaggtcaggagatcgagatcattctggccaacatggtgaaacctcgtctctactgaaaatacaaaaattagctgggtgttgtggcatgtgcctgtagtcccagctacgtgggaggctgaggcaggagaatcagttgaacccgggaggcgaaggttgcagtgagccgggattgcaccactgcactccagcctgggcaacagactgagactgcgtctaaaaaaaaaaaaaaagttattggggtaaaatatcattggttcaaattgatacttctcactaagggacagaggtatttttacctgcttcatctctgctaccttaaatttgaatctcctttgtaccacaacaaaaccctagttctccatgttaacacagtaactcatttgctttattccgtatcactcatctaacagtctcagaataacaataccaacactaccaccagtttgattattaacagtgtttatttgcattttttccttacccttaagaaaaatacccttaataagtgttataaggtcatttagattagtttctgtctaagtgactgtaccaccaacttaataactaaggttcatttgcttcattttatgttttattttgtggaattgctttttaaaatttaattttgctttataaatacattattatatataattctgaaatatatataattctgaaaagtcaagtctataaaacagagtatattcagagaaatctctttcaccttggtctttccttctgccataggtaaccacttctttttaatcctatagtttatcattcaattttataaaaaatttaggcatgtgtgtgtgtctatgtgtgtatgtgtgtatctatcccctgccttttttcatttagtgatatgtcctaaatatgacattgcagtaacatggagatgctcttcattcttacactgtagtgtgttattcttgcactactttatgaatcactatttagaagcatttgagaggctattaaaaaatacaagttctcagggaacatagtgaccatgtaaatcaaatatttccaaaaattctccagaaacctacagatcaaaaaggaaacaatccacccataacttatgcctaaatataactaggagccgagaatgccacaattatcagttactttttaatggggatataaagatctgaaaccagcagagccagtaccagaccatacataacgaagaatttatgtaggtggaaattgtataaaaaagggagagaacaatgggggcctaacagagccaaaattgcccccagaatgagatagtcccacccagaatgggaaatactgagaacagagctaagatcttgtggattagagcacaaactattggaattggaaaggagagtcaaagttgaaagtggactggagatggcagtcctggggagaaaacttcctctgtggaagagggagacttaacgttgaagggaaaaaaagacagcagggggtaaaatttaggattatacagaataaaaggcataccattcttctcatcctaccttaaacaggcccatctattaaagaaattgtatttcactatgccaactcatgacccaagttccctgccaatagaaccttttgtttttttgctggtctgggaaaatttaagatatataaaaatggtgagaaaatagcacttgaaaatttataaaaagcttcaatatgaagaaaaacataagatgaggataaaaccatttcaactactgaaaatgcttccaaaaccaacgactaatcagaggaaacctgttgcacagcaactcaacttgagttaaacaagtcttggcagatatgaaaaaaataccttgaatcataggttgtaaaagtcaagctagacatgcacaatagacaagaagatgtgaaaatagtattgtccaaactcaagaaaaaaaagacaaaattatctcagtggaagactgaattccaaggtgaacaacaggacaatagactcaactgaaaatgtaataagggacattaaggagggaaataaaaagccaagagaataaaaataaatattagaaaaggttaaaaagtatctcaaaggaactgttagatatagaagataatgaacaaaaatccaatatgtatatgtacacgatatgtatatgtatgtataactgaaaacccaaaagaagataaacaaaacaatggaacagaattaacacttaaataagaaaactttccaaaaattaaagcagacctttacctttrtatttataggacctacttttgattcagattggtcaactctaagacatattttagtaaaactattgtattctaagaaaatttcttctaaacttctggcaaaaaaaaagccaagtcttttacaaggtaaagaaagtcaagtttgcagctgtttttcaggtattgaggttatactgaaatcgttttcagcatgcagaactcagggaatattataaccccaagcccattctgaggaataaattagagaaagctcttcatcaaagcaagagatgatcaatttaagacaaaaacaaagcaagggacaagggtagaatagtgtatgtgtgtatcaggctcagtccagtgaagagagaaacaacacagtaatttgaacatagaaagtttaatataattgttaactataacagaggattggagtaatgagggatcagttagtaaaggaaagataactctaaagaaattatatgagtagcaaacataaagaaaagccagactctgaggctgagataaagtgcccaaggaagagcctctcctcccccatcctgagggctgaggtatagggctgtgttctctcaatgacagagaaatcactgtggtgytatgttggtggaacttgctaggaactcccctctatggtgctcaggaaagctgttcgttgagagatatctctctacagtaactctactatgaaaccacccaaggtgagggtaaggatgctgctgcttagaaagagatgcagacaaatgtactaatgaaggctcaacacagctctttcaaggcaagacaggtcaagaggacaaaaagtaaaagtatgaaaggctttaagaaatcaggtagatcgtaggtgtatgtgtgtgtgtgtgtgcatatgtatgcatgtcaaactttagatccttataaatgatctgccttgaaatttaaaaatctaaatagctcttagttgaacaggggagatataaacaaagtttgcaaaattcctaaaacacgatgataataaacatcatacatcagaattttgagatataattaaagcagtacttagaagaaaatgtatagccttaaatatttaacatcagtaaaaatgaaaggatgaaaattgggatttaaattcccaactcaaagagctagaaaaagaattacaaagcaagaagaaaaaaaagataaaggaaattaatgaggcagaaaacagaaaagcaataattcaaagttaattcaaagtactggtcctggccgggcatggtaattcatgcctgtaatctcagaactttgcgtggccaaggcaagaggatcactttgaggctaggagttcaagaccagcctgggtaacatagcaagaccctgtctcaacaaaaatgtttttaaaaattagcccagcatggtggcatatgcctgttgtcctggcttttaggaggctgaagcagaaggattgcttgcacccaggagtttgaggttacagtgagttatggtcataccactgcactgcaacctaggccacagggtgagatactgtctcaaaaaaaaaaaaaaaaaaaaaagtactgtcctttgggagaaaaaatgtccatgaaatagacaaaccactagttagcatagtaaagaaaaaaggagagtaggcacaaacatagaaaataagaaatggccgggcacaatggctcacacctgtaatcccagcactttcggaggccgaggtgggcagatcacaaggtcaagagattgagaccatcctggccaacatggtaaaaccccgtctctactaaaaatacaaaaattagctgggcacggtggtgcatgcctgtagtcccagctactcaggaggctgaggagaatcacttgaacctgggaggtggcggttgcagtgagccaagattgcgccagtgcactccagcctggcaacagagtgagactccgtctcaaaaaaaaaaaaaagaaagaaagaaaagaagaaatgacaaaggggaaataactatgcagataaatttgaaaagttaggttgaagtaggaaatactatttgtcaaaattaacttcaatagcattacaatatttaaacagatatagaaaacatggccaggcatggtggctcacacctgtgatcccagcacttttggagtccaaggcagacagattgcttgagctcagaagtttgagaccagcctgggcagcatggcaaaactctatctctgcaaaaaaaataacaaaattaaccaggcgtggtggctcacgcccatagtcccagctacttgggaggctgaggtggaaggatcacttgagcctgggatgtggagattgcagtgagttgagattgtaccactacactccagcctgagtgaaagagtgagatcctgtctcaaaaaaaaaaaaaaagaaaatatacaaaagttttcaaggaactgcacctacagtaagcaccatgtgtagattatgtcacagggaaattaccaaaccttaaggagcagatagtcttagtgctagttgagttgtagttcaacaatacccagcagaactttctgcaatggtggaaatattttgtatctgttctattcagcatgatcctcaccagccacatacagcaagtgagtaagcacttgaactggctactgtgactaaggaattgaattttaaattgtatttaattgtaacttaaaaggccttgtattagtccgttctcctgctgctataaggacataacagagactgggtaattataaagggaagaggtttaattgactcacagttcagcatggctagggaggcctcaggaaacttacattcatggtggaaggggaagcaaacacatccttcttcacagggcagcaggaaagagaagaatgagagctgagcaaagggggaagccccttataaaaccatcagatcttgtgagaacttactcattatcatgagaatagcataggggaaactgcccccatgattcacttacctcccactgggtccctatcatcatatgtggggattatgggaactacaattcaagatgaggatttgggtggggacacagctaaagcatgtaaggcctgatgtggctagtggctattgtactgaatagtgtcattctagatcacagaaaaagtaggaaagcatctgaattgtttttatgagacacatagaactgtgttgcctaaacctgatttatacacatgtgcccacacacacatgcagatgtataatctcatgtatgaatactgttattaaaatcctaaataaaaggaattaggatttaacatatttaaaacaacaattcatcaagacataatagtaggttggattttggggagaatgaaaatatttaactttagaaaaatcattaatagaattcaacatattaaaaaagctaaggaataaaatcatatgagctttgacaaaattcaacacactactagcaaaaaaaaataataaaccagaaaatgggtactatatacttaacttggaaaaaagtatgtttatacctcagtactaaagccaacattttacttaatggtttaaaataacctgatagaagatacatggaagacaaactcccattttcaatagcaggtaaggggtgagggaaaactaacaaatgtgtgaaacttacataaagaaaactttgaaaaacctgaccaaaaagcatgattaaaaaataagtcatagagtagactttgtcaaaattaagaacttctgctcttcaatagacactggtaagagaatgaaaatacatattgactttgtatcctgagactttgctgaagttgcttatcagcttggggctgagaagatggggttttctgaatatacaatcgtgtcatctgtgaacagagacaatttgacttcctcttttcttaattgaataccctttatttctttctcttgcctgattgccctagccagaacttctaatactacgttgaataggagtggtgagagagggcatccttgtcttgtgccagttttgaaagggaatgcttccagtttttgcccattcagtatgatattggctgtgggtttgtcataaatagctcttattattttgagatacgtcccatcaatacctaatttattgagagtttttagcatgaagtgctgttgaattttgtcaaaggccttttctgcatctattaagataatcatgtggtgtttgtcattggttctgtttatgtgatggattacgtttattgatttgcgtatgttgaactagccttgcttcccagggatgaagccgacttgattgttgtggatacgctttttgatgtgctgctggattcggtttgtcagtgttttattgaggatttttgcatcaatgttcatcagtgatagtggtctaaaattctgtttttttgttgtgtctctgctacgctttggtataagggtgatgctggcctcataaaatgagttagggaggattccctctttttcttttgcttcgaatcctttcagaaggaatggtaccagctcctctttgtacctctggtagaatttgactatgaatccatctggtcctggactttttttggttggtaggctattaattattgcctcaatttcagaacctttggtctatttagagattcagcttcttcctgatttagtcttgggagagtgtatgtgtccaggaatttatccatttcttctagattttctagtttatttgcatagaggcgtttatagtattctctgatggtagtttgtatttctgtgggatcagtggtgatatccactttatcattttttattgcatccatttgattcttctctcttttcttctttattagtcttgctagcagtctatattttgttgatcttttcaaaaaaaccagttcctggatttattgatttttttgaagggtttattgtgtttctatctccttcagttctgcacttaccttagttatttcttgtcttctgctaacttttgaatttgtttgctcttgcttctctagttcttttcattgtgatgttagggtgtcgattttagatcttttctgctttctcttgagtgaactcccattcaccattgatacaaaaagaataaaatacctaggaatccaacttacaaaggatgtgaaggacctcttcaaggagaactacaaaccactgctcaacgaaataaaaggacacaaacaaatggaagaacattccamgctcacggataggatgaatcaatatcgtgaaaatggccatactgcccaaagtaatttataggttcagtgctatccccatcaagctaccactgactttcttcacagaatgggaaaaaactactttaaatttcatatggaaccaaaaaagagcccacatgaccaagacaatcctaagcaaaaaggacaaagctggaggcatcatgctacctgacttcaaactatactacaaggctacagtaaccagaatagcatggcactggtaccaaaacagatatatagaccaatggaacagtacagaggcctcagaaataataccacacatctacaaccatctgatctttgacaaacatgacaaaaacaagaaatggggaaaggattccctatttaataaatggtgctgggaaaactggctggccatatgtagaaacctgaaactggactccttacaccttatacaaaaattaactcaagatggattaaagacttaaatgtaaaacctaaacctgtaaaagccctagaagaaaacctgggcagtaccattcaggacataggcatgggcaaagacttcatgagtaaaacaccaaaagcaatggcaacaaaagccaaaattgacaaatgggatctaattaaaataaagaacttctgcacagcaaaagaaaccatcagcagagtgaacaggcaacctacagaataggaggaaatttttgcaatctacccatctgacaaagggctaatacccagaatttacaaagaaaaacaaatttacaagaaaaacacaaacaatcccatcaaaaagtgggcaacagatatgaacagacmcttctcaaaagaagacatttatgcagccaacagacacatgaaaaaatgctcatcatcactggtcattagagaaatgcaaatcaaaatcacagtgagataccatctcacgccagttagaatggcgatcattaaaaagtctggaaacaatagatgctggagaggatgtggagaaataggaacacttttacactgttggtgggtatgtaaattagttcacccattgtggaagacagtgtcgcgattcttcaaggatctagaactagaaataccatttgacccagtgatcccattactgggtatatacccaaaggattatgaatcatgctactataaagacacatgcacacatatatttattgcagcactattcacaatagcaaacaattggaccaacccaaatatccatcaataatagactggataaagaaaatgtggcacatatacaccatggaatactatgcagccataaaaaggatgagttcatgtcctttgtagggacatggatgaagctggaaaccatcattctcagcaaactatcacaaggacagaaaaccaaacactgcacattctcataagtgcgagttgaacaatgagaacacgtggacacagggaaaagaacatcacacaccagggcctgctggggggtgggaggctgggggagagatagcattaggagaaatacctaatgtaaatgacgagttgatgggtgcagcaaaccaacatggcacctgtatacctatgtgacaaacctgcacgttgtgcacatgtaccccagaatttaaagtataatacaaaataataatagttgaaaaattagaaaaaagaaaatacaggccacagactaggagataatgtttgcaaatcacttaactatcagtaatattctccaaattgatctatagatgcagtgcagtccctatcaaaatcccaactgcctattttgcagaaattgacaaattggttctaaaattcttataagggacccagaataatcatagcaatattcaaaagggaaaacaaaggtggaggactcacattttctgatttcaaaacttactacaaagctatagtactgaagacattgtggttctggcatgaagacagacatatagatccatgaattagaattaagagtacagaaatgaacctaccaatttatggtcaattgatttttcacaaggatgccaagacagttcaatgtgattttcaacagctggtgaggaacaaatggatattcacatagaaaaaaatgaagttggaccctacctctatgccatatacaaaaattaatttcaagtggatcatggacctaaatgtaagagctaaaatgagaaaactcttcgaagaaaacaggaggaaatcttcatgaccttggattagataatacagcaccaaaagcacaaaaaaacaaaagaaaaaatagataacttgaacttcatcaaaactaaaaagcttcatcatcaagaagtgaaaagacagctcacacaatgggaaaaaatagccaaatccatgtaagcagaaagtagatttgtggtttccagagtccagcttgaagtggggatggggagtggctgctaataggtattgggcctctttttggaggagtgatgaaaatattttaaaattagataaagtgatgtttgcacactttgtatgttcacagagtactaaaacccattgaactatatacttaaaagagtaaattttatggtgtgtgaattgtgaagctaattttttatacttacatatctaattcagtaatgctagaaaaatgacatatacacatgcaaaaaaatgaagttggaacttaaccttacactatatacaaaaattaactcaaaatgtatcaaaggcctgaatgtggggtctaaatccataaaactcttagaagaaaagctttatgacattagatttgaatatgacaccaaaagcacaggcaacaaaagaaaaacatacataaattagactacatcaaaattcaaaacttttgtgcatcaaaggacactattgacatagtgaaaaggcagcccacagaattagaaaaaaaattcacaaaacatatatctgataaggggttaatattcaaaaaatatttttaaaaactcctgcaactgtgttattcaaggtttatgatatttaaaaaattaaaaataaaaactcctaaacctcaacaacaaaaaacccatttcaaaaattagcaaaggacttgaatatatttttttccaaagaagatgtacaaatggccaattagcacatgaaaatatgttcatgatcactaatcattagggaactacaaattaaaactgcattgagatgacacttcacattcattaggatgggtattaggaaaaaaacagaaaataacaagtgttgatgaggatgtggagaaatgggaatgtctgttgctggtaggaatgtaaaatgggagtttctcagaaagttaaaaatatcatgcacctgtagtcccaactacctggaaggctgaggcaggaggatcgcttgaacccaggagttcgaggccagcctgggcaacatagtgagacccccaactattttcttaaaaagtaaaagtagaattctgtgattcagcagttccatttctgggtatatactcagaaggactgaaagcagggacttgggcagatatttgaatacccgtgtttagcagcattagtcacaatagccaaaaggtagaagccactcaagtgtctgttgatggaagaatggataaagaaaatgtcacacatacgcacacacagaaagagagcggggctggggaagagagagagatgcaatgggaatattattcagccttaaagaggaaggaaattataacacatgctacaacataggtgaacctcgamgacatgctaagtgaaataagccagttataaaagcacaaatattgtatgatttcacttagatgagacatctagagaagtcaaatrtatagagacagaaagtacaatagtagttgccaggagctgagggaggaggaggtgaagaggttgataataggtacagagtttcagttggggaaaatgaaaatgtcctggagatggatggtggtgatagttgcctaataatgtgaatggacttaatgtcacagaactgtacactttaaaatgattaaaactgtaaatttgatatatattttaccacaaaaaaaattaccaggcatgcaaacaagcaagagaaaaactcacccattataattagaatccagaaatmacacagattatagaattaatagacaaggacattaaagcagttgtttatattgcatatgttcaagaagatagaggaaatcatgagcgtcatgagtagagaaatgtaggatttagatttaaaagaaccaaattgaactttagaggtagaacatacaagataatatctcaagtgaagaataaactgaatggatccacaacatattactgttggaattgcttcaggaggaagatgagcagacttaaaaacagcagtataaactatccaaatgaaacacagagagaaaaagaactgaaaaagaaagcatcagtgagccatggaacaacttcacgtagcctataacatatataactggagtcctgaaggagagataaggagcacataagaaattattagaaaaataatgcttgaaaaatttttgaatactatgaaaactataacttcacaaatcagagaagctcaatgaaccccaagcaggagaaatatgaaataaaccacacaaggcacatcatcatcaaattgctgaaaacccacgataaagagaaaagtcttaagagcagccagagaaaaacaagcacatgatatatagaagaacaaagaatgacagcaacttctcgtcagaaacagtgcaagccagaatacagtggagcagcatttttaagttctaaaaggaaaasaagttgttaagctagaattctataccaagcaagaatgtctttcaaaaataaaaatgaagacatttgcagaaatataaaagcttagagaattaatcacaagcatatcagtactacaagaaaggttaagtgaagtccttaaagcagaaagaaaatgataacatggaaaaaatggatctctgcaaagcaatgaggaaaatttgtaggtaaatataataaaatttgtagtgtacatataataattcaaaaatagctaggaactcctaaaaaagaagagcaatgtgcagagagtaatcccattagctattaaaacatactttaaagcctctgaaattaaaattatatggaactggcacatgaataggcagactgagcagtgtaaaataaatagcaaatccagagatagatctgactgtatatgaaaatttgctatatgataaaggtagtgtggtagtctgctgaggctgtcagtgaaataccacagactgtctggtttaaacaacaggatttttttttctcacagttctaaagactggaaagtccaagatcaaggttctggcaggggttgatttctgctgagggtcctcttcttgcttgcagacagccatcttatggctgccttctcactgtgttctcacaggagaaggaagaaggaagggagggaagtggagggaggaagagagctcttcctcttcttataagaccatagttctatcaaataagggctctaccccgtgacttcacttaaccttcatcatctcctaacaaccctgtctctgggtacagttatattgaggattaggacttcaacatattaatttgggggatggagattcagtccatagtggttggcatattaaattggataaaattgactttttcataaatgacattgggataagttaatagccattaggaaaagatacaattgaatccatatatcacagcgtatgtcagaataaactgcacgtggattagagatcaaaatgtaaaaaaatgactatataagtactaggaaaacacaaattcctttataaacttggggtggggaaagcctttttaaatatgattcaaaatctagatagaccgacaaatttgactttttaaaacatttttaggggaaaaaaayactccaagcaaagctaaaagacaaatgataaatgggagaaaatatttgcaacataaggcacagataactctccctaattcataaagaacactcataaatagaaaaatagaaaaattttttaagactaaaacctatagaaaaatgatcttaaggcatgaacagttgacagaagatatacaaatggtcctcagacatatgaaaattcacaccactcataataaaataagtgcagattaaaaccacagtaagatattctttcttaccagattgacaaaaattccaaagcttgaggagacagcaaggctgtggggaaataagcgttctcatttttttttgctggggacatgcagaatggtacatttcacaccagagagggagggcatacaattcatcagtatctgagaaaaaccacatatgcatttattagttgacccagggatcccacttcaggaatttgattttaaagatgtactgccacaaaaataaagcaatatacacatggttatttttttgcaacattaagagattgattgaatgttatatagtacattcacacaatgaagtaccattcaaccataaaatagaatgaggaagatctgtgtaaactaatatggagtgatttctaagatatatcattaatgtgaaaaaagaaagttgcagaaagtatatataatacgctaacttttgggaaagagaaggggaaatatgtatgtatacacatatgcacacatatataacatatgaaagtatgcattttaaatttatttttgtaaaaagaaacacaggaatgtcaagccagaaaataatgaaaagatcacccattaggcatgtcttggaataaggtagaaagtactgggataagagtgaggcttttgaaaataccttttaatattcttttgacttttgaactaagtattttacttaataaataaaattaaactaaaaaagatgaacaaagcaaaccctaaaattgattagaaacaaacaaaactgaatcaaatggatgtaataaccacattgaaaaaactattaattcaaataaaattttaacatagaaccttcacagtatacctttaatatggggcatattctaaggaaaaaatggactgcaaagaaattttgacttcttaataatgtttgtggttttggcatggttatctgagactaatttgcagatattgaaaatagagcaaatgaataaataagattctaatatggaaaaagatgaggaagaaccctgtagtattggatttgaattggagaatatctgtatctactctggcctttaaaatatatttatatgtatgcatcctattcaagtaatacatatatgtaacatatgatttgtatgtgtgtgtgtatatacatatgtattttccaagcactgttcattgaaagggcctagaagcaattacatctcagtagcaatgaygacaccttgattttggtttctaaaaatcacctgatacacctgtaatcccaacactttgggaagctgaggcaggaggatcccttaagcctaggagttcgagaccagcctgggcaacatggcaagacccccatctctactggaaaacattaaaaatgagctggacatggtgtcacgcatctgtggtcccagctacttgggagactgaggtgggagtatccccttgagtctgggaggtcgaggctgcagtgagccatgmtcatgctattgcactccagcctgggtgacagagtaaaacctcttctcaaaaaaaaaaaattaaagttggagggaagaaatctcctttacagaatgccagccaataaatatagaaggaatgaggctgggcaaagtggctcacacctgtaatcccagcactttgggaggccgagatgrgtggatcacatgagcccaggagtttgagaccagcctgggcaacatggtgaaactctgtccctacaaaaaaatacaaaaattatctgggcatgatgacacacacctgtagtgccggctactcaggaggctgaaaaggaagaatcagctgagcccgggaagtctaggctgcagtgagcggagatctcgccactgaatttcagcctgggggacaaagcaaaaccctgtctaaaaaaaatatatagaaggaatgagagaaaattacttttttgcaactattttaataattgagtcaggcaagagtaaccaataaatgcttaaactattaggtaaaaaaacatactgaggaataggatgttcacagtctcaaagtttctctccactgattgcctgtaaattacaaagggaaattacagtgaagaacactgtcaatcacctcttaacatgtgatcaaattttgtatcttcagtaattagacaaactgacattatgtgcctcctgcagtattgcaatgagaaatactccacatcacctgtataatattttttatcaaatctctttagcaggccaggcctagcagtttatgcctgtaatcagagccagcactttgggaggctgaggcggaatgattacttgaggccagaaattcaagaccagcctgggcaatatagcaagtcccccatcactacaaaaaatagaaaaattggccaggtgtggtggtgcacacccttagtcctagttgctcagggggatcacctgagcccaggagttgaaggctgctgtgagccatgattgcaccactgcacaccagcctgggcaacagagaaagaccctgtctcaaaataaataaataaataaataaataaataagctcttcagcatgaatgtaattatgaggaaacgatcagaagaagtccaaactgtgggacattctgtaaaacataatccagactcttcaaaaatgtcagtgtcatacaaagcaaacaaaaggcaacaggactattatacatgaattctacattaaaggagactgaagaaacatgacaaccaattgcagtatgtgattcttgattggatcctgtatttaaaaatcaacagttttaaagaacattttagggacaaatgagaatatttttaattaaatttcctgagtgtgataatactgcaattttgtaggggaatgtcttttttcaaatatactgatatatttaggggtgaagtgtcgtaacatctccaactttcatatagttcaggggtggaagcattaatatatgtagatgaaaagcagatgtgggaaaatggtaatagttgttgaatctagttgaagggtacataattgttcattatatagtttttgctattttctctaggtttataacttttcaaaataaaattaaaaaaataaaattatttatatataattgtacatatgtttgtgtgtccatgttccccaggccttctctggacttctttctagagttgctgaatcagaagctctaggtaatggggcttgggattctgcatggcaaaatggctctcctgagatactgacacaactggtctatatttggaaaacattgctctggaagagcatccttttccattaaaatcttgcatggtgtatatgtatacgtatgtgtgttctgttctcataagggatattactcttttgcagtggagtcctccaaggataaaacatgtagtagagtagaatgattctcctcagttatctcaaagctgccactcttctcctcacagctccctgttattactgactgattcttctacttaatactgtgattgtttcttctaaagagggctgtctagagcatagttctcaaacttggctacctgttaaaatcacctagggagctcttaaaattttcagggtctaggccttaacttcagatcagttaaatagggatttctgggagtggatctgatgtattctttaatgttccctaggggattccagtccaagtttgagagtcactgagctggagtagaagctagcctttaatgaggcccctagtcaagtgagtcacgatctcagtgtaaactgcttacccagcaaatttggtcacatgctttagtatatacagtaacttcaaaggaatcctttgtatgtttctgtcactgatcaattcctggtgtgaatgctcttctgttacctgccaccagagggcatggactatgattagattatagtcctgctgctccacatgtatgtatgtatgtattgaggcagagtctcgctgtgtcactcaggctggaatgcagcgtcacaatcatagctcactgcagcctcgacatccccaggctacagcagtcatcctgcatgagccttccacgtagctgggactacaagcacacaccaccacacccagctaattttttgtattttttgtagaaacagggtctcactgtgttgcccaggctggtctttaaattttgggctgaagtgatcctcctgcgtcagtcycccaaaatgctgcgattacaggtgaaagccactgtgcccggcctgcagctccactcttaaatccagtttcatcagctggccagtttaaagagatggaccctagcttatccagtggtcccatagtcttgggagcacctagaagcactttagaagtggttctttatgaagttttaaaaaatgaatccttggtaaacacagagcacttgcagcctgtgtttggaattaaaagagatctgactttgtaatattaacttagccactcactaccttagttgtgtgactactggtaagttgctttaccttgacttgtaacgttgagtttcagtgcccttacctgcaagatgattaataaattcttccccatgttgtttttgtggattaagtggaataacataataaagcgttcatcaattcttggcacccatttaataaatggagggttttttccttaattcaataaaactatcaaggattttgtattctagttggagaagacatacacattaaactttttaaaaagaaaattcagatggtgataggggctaggaataaataagaaggaagcaggatagatttaggagtctattttgggtaaagtagtcaaggaacacctttctgaggaagtgatgtctcagcaaataactaactgtaaagagttgattaaaaggtgtttgaggcagagggaaacagcttggtatatttgagaacagaaagaccaatgaataggggtacaagggagtgataagagatgagtaatgaggagtaagcaaggtccagatcatgtaagccttgtaaacatgaataataaagagtttagatctgttttgtgttgtgaaatttgagcataaggtaatgtgacctgatttatatttttaaaaacataaccatattattctggctgcaaaagtagagggctgaggtccagttagaaggctgttggagttgtctaggcaaagtttgactctggcttaaattagggtaatatagcagtagagatggtgaaatgtgggtcgatctagcatatattaagtgggaaagccatcaagacttgctgattaattgggtttggtgggtgatagaaagggaagaatcaakgatgacttctagtcttttaggtctgagcacctgggtttaataaggggtgccacctattaaactgagatgggataactggaggaaagaacaagtttggagggaatagtagaatcaagagtactgtcttaaacttattcattttacgwtttcttagacatccaagtagagttatagactgaggtagttggatatatgaacatgaaaccctgagcagaggttttggctagatatataaattgacagtcatcatttaacaggaagaaagtggggaccaagaagaagacagaagcaatgactgagcactgaggtgctctacatttagagattaggatttcctcttacccacctgtccttttccttatagacagcctargtcgttgcctaatttgaatagagcctcaaattactgttttcatcttccttcttttctctctttcacaagtttatgactccaacccttcttacctagagacagtgtggtaggactgagtgataaaatatttgacgatattaatgtgatgattagttatgaaagctctggagacggagtagttgggttcaaatcctggctctgctatttactaacttactaactttggatattttacttaatttctctaagcctcagttttttcatctatagttacaaaaataatagccaatgtttatctaactcctgcctgtatgccaggcagtgttttaagtcctttgcatgtattagcctatttaatctttagaacaacccattgattcttatcccatgctgttgttgaggaaactgaagctagagagaggttttgtaattttccaaaagttatgtacctggtaagtggcaaagctggatttaaattcaggcagtctggcaccagaaactgctactcctctagtatctgattcagaatagtagtagtgatccactgcaaatgcttagcacaaggagctggctcatgatatgtgtacaataaatgttaacttttggaggcaacatagtgtaataaaagagatagtgtaataaacatagtgtaataaaagagaaccaaataagaagtcctggggttccagcctgacagtgtaagattggcttgtgtgaccatgaacaagtttcttagcctctctggacttcagtttcatcatctgcaatgtaagatctttgtacttcatggcctctgaggtccctttcaatgttaaaattatctactatctatgattgcccaagaatattgaggtaaattatggatatacttgaatttgaagggatagagtcccacatcacctagcggattgaggaataagataccttagcaatttcttgggttcaaaatatttctgctttgcccctgtactcttgaagaatcctgctggtagtgaaacatagtaaagaaccacaaagtttggtatccaaccaccatatattgaaatctgtctccggcatttactagcatgaccctagacaagctgcttctctgagttttcattttttatcatctgtagagtagggataataatagtgcctgcccatgttatttcaratattgagtaagaaatggcatataaaatgtttaatacatggtaagcattcaatatatattaactattatgataatattgtaatgatttccaaagctgagaggattttttagctccttaagcttcagatgagatagaaaccccccagtaacccctacctcaaaaatggaattgggaattacatggctaggcactctagtcattgataactataggcattaaacctgaattttctaattgtgcaggcctccctataccaaggtgtatagaccacttctctaaaacagtagtgccttgctttaccttatccataggtgtaccaaaccactcatggcaaagctgctctgggtttggcttgcttcagcccttccctgacctaaggagagttgttttcccacataaacaccacgcttgaatttctggagggatttaatttttttaaaccattgtcaaaagaagagtagcagttaaaaacccagctcaaaccagattagagagggaaaaaaggaggaggcaggaattattaactcatataaccaagaagtccaaggatttatctggtgttgagtgtctgagtactgggttttaaacactattatgtgtctccatcccatgctgtactttggctttattctcaggtctgttctccatgtagcagtgcccaaactgcaaacatccttatgggcatgttctcagacaaagaaagatgttcttctccaacgtcaatctcatgtcaaaaaacaactggcctaacatgggacatagacacatatacactcttggtctaggggaatttgatgctcttaaacagcattgtgttttaccccaaggccaggtaggtaaggaccacatatgtggttgacgtgcccaccaaatcatgtggagttacggtggggttttttttgtttttgttttttttttgccctaaagggaaaaaaaagctgggcaagcaaaaaggaagtgatggcagttttagattgagtgataggaaagtccacattgctgttgatatggatgggctgtcccaagaaatctctttaccttgggaaggctggcttagcctagccagctttgggactaaaagtttaaatagtatggagtggtaactctttttttatttgcatttccttgtcacctcctcctcctaactttaattacagttgttaattgatacttttttccaaaagctgaatcttcccttttcattttacccatacattgccagttttaaagtgtgggctcaggagtcagattgcctgaattttaatcctgtcttttcrtttgctcactttgaaatcttaagcaatttatttaacttcaaataaattgtacctgtttcctcatctataaaatgaagataatatctacctcctagggctgtcttgaggattagatagtcaatagaaagtgattggcatagtgaacagtaaagtgctcaataacatcagatactgctgctgctgttatttccagctttgcagcttgggtgcagcttatctgttcttttgtttggagtgggaaggctgaggtagtttgggaaatgctcaaaaaacattaggttttgttatctcaggatgcagagttgaagcaaattgaaagaagcacttggggctctaattggaagacctaactgtaataatgatcttatttttacaattcattgataggtgataatggacagttaacctctctaggcttctttttactcttttgcaaaatgaagatttttggataggacaatcctttccaatgtcattccttggtccttagttgtttaagtaaacaatgaacttcagaaagtattttgtacttggtgtgtgtatgtgtgcaagacagaaagtgataagagaagtagtgagttagtttacattgagaggaaccaaaatgatttacttatatattgggtttatcggttgacatgtttggtttcttcttaagagattattagatcccctttcatactctactgtccagatcatctctaagtattcgttaatcctatcacatcttttttggatttttcaaatgcctagaaagttttctaggcattacgttatgtgttctgtagtacttgtcttaggaaacttggtttggagactctgtcccactatttactttacagcattaccttggacaagttacattctctcttatgtgcctcattttcttcatctgtctaatgaggtgtttctcctttttaacccttaagtcctttcttaacagtctgtgattctgtaactatcacagcataggagtagctggattctaaaggctgaacttgatatcataatgtagagtccagccccacagggttggtgggttttctccctgtgtgcggagacaagagagtgtagaaataaagacacaagacgaagagataaaagacagctgggcccagggggaccactgccaccaagacacrgagaccagtagtggccctgaatgccaggctgcgctgatatttattggatacaagacaaaggggcagggtaaggagtgtgagccrtctcccatgataggtaaggtcacgtgggtcacgtgtccactggacagggggcccttccctgcctggcagccgaggcagagagagagagaggagagagagagagacagcttacgccattatttctactaatcagagacttttagtactttcactaatttgctactgctaactaaaaggcagagccaggtgtacaggatggaacatgaaggcgaactaggaacatgaccactgaagcacagcatcacagggagacagttagacctttggataactgcaggcgggcctgactgacgtcaggccctccgcaagaggtggaggagtagagtcttctctaaacttccccggggaaagggtgactccctttcccggtctctaagtaatgggtgtttttccttgacactgacgctaccactagaccacggtccgcttggcaacgggcgtcttcccagacgctggygttaccgctagaccaaggagccctctggtggccctgtccgggcataacagaaggctcgcactcttgtcttctggtcacttctcactatgtcccctcagctcctatctctgtatggcctggtttttcctaggttatgattgtagagcgaggattattataatattggaataaagaataattgctacaaactaatgatgaatgatattcatatataatcatatctatgatctatatctagtataactattcttattttatatattttattatactggaagagctcgtgccctcggtctcttgcctcggcacctgggtggcttgccacccacatcaccattcatttttgaaacatacttttaatctgttgcccattatgcttgctgcaggatttcggctgaatgcgtcttcttggcccatgttccttttgaagacgctaaatggagcagagatggctcccatcaggattttccacaaggtaggctatccctcagatatcaccagctccaggctgcttaaggtcaaatattgagactttgatgtccacatttacttatggcctgaagatgccttctcagaaattagttcagaaggattttttrgtagcttatgaagcagcaattatccccagaggaatatattagactataaggtcccatagattagattatatggtcccagcttccagtaatctctgtttacctgtcgggcttgttaagaagttaaaatgtattattagtagaatatgttaaatgtaatacaaatctaaaggcgctattcttattatagatcttggagttctgtagagttcatgttctaaacagagaaaagaaggagactttttttattgcctacgatatgtttgggactttatatatactatctcatgtaatacccacagctaactttatgaactaagaattattatttccatttaatagttaaggaaacaaatacttttgaattaggagcttgctcaagatcacgtggctagtaagcggcagaacagggatccaaaacctgtatttgttattgcttctcaagaagtgaggcagtgagtctatcmgttgaattttctaatggggtaaaagttactgtaaagggtattraattaggtttgcctatgctgctagttaagtctcaacactaagagcatcctgcttctgaattacctagcacttatgtaactcaggagtagttcttgtattctttgggactagaaataaagatgagttttagactttgttatgccagctgtgcagtaaagggatctaccaaaagactccaagtagaatgtttaacttccggatcagtggagggggaaaatagaagaaaacttagttgattgaaaaggagaaaaaagaactttggaaattcaaattaaatagaaacatagacaataaggtagttgtaataaattcagatacatcaattatcacaagaaatgagcttaagctcattataatcatacatagatcagatttttaaaaatctagctatatgctatgtataagagacactaaacataatgacaaaaatgttgaaagtaaaagaaatctacagagggtgggaatgatggaaaacaaattttttaatttttaaaaaagaaaataaaagaatatgaaagatgtgccagatgaacttttatcaaaataaagctggcataaactatacggaaatcacgcaagactttgatactaaaagtctaaatgatgctaaaagcactgagtccaggaatttgagaccagcctgggccaccygtagcaagaccccgtctctagaaaaaatttaaaaattagctaagagtggtggcacgtgcctgtagtcgcagctacttgggagaccgaggtggaagaatcgcttaagccsaggagattgaggctgcagggagctgtgtttgcaccattgcacaccagcctgggtgacagagcaagaccctgattctagaaataaataaataaaatgcattaaagaggtcactatctaattatcataaagtacagttcaccaggaagataaaacagtcataaatgtacatgctcctagaaaatgtaatctcaaagtataatagagcaaaatttgacaaaattacatggtaaaattggaaaatccacaaatcactagggaatatttgaagacttatctcttaacaattgataaatcaagcacacaagaattggtatgtcaatcagcataagctaataatcagtatcgaataagttggtcaatttttaaaaatcactttatttgcatttaacaacagttaaatttaaatgatttgaaaataaattttttaaatgccacttatgatagcaatggaattgtaatttgcctagaaaaaaagttagtaaaaaagcatgagatatttatagaggaaatttttaaatgtatgttgaagaaatctgcattaaagaaatcttggccaggcayggtggctcatgcctgtaatcccagcactttttgggaggccaaggcatacggatcacttgaggtcaggagttcgagaccagcttgggcaacatggtaaaaccccatctctacaaaaaataacaaaaattagcagagtgtggtggtgtgtgcctgtaatcccagctacttgggaggctgaggtaggmggatcacttgaccctgggaggcagaggttgcagtgagccaggattacaccactgcactccagcctggktgacagaaccagaccctttctccaaaaaagaaaragagagagagagagagagagagagagaaaggaaatcttaacaagtggaaaagactatcatgtttatggatgggaaggcttgatagtatataataaagkttatttccacccaaatttatctataaattcgttgtaattccagtcaaaatcctaatagggtttatatatggaactcraaaaaactgattgaaatttatatgaaagacagagaatgaatagcaaaaacaatattgaagaatgacaaagtagggggacttttcctatcagatatccatttaataagactatgttattggtacaggatcagatagtaagattaagggaacagaatagaatgtacaacacattttttgaaacttgatctatgtaactgcattacaaattagcacccaggaactctctacacttccggtgaaagtatacaatgttacaaccactttggagtacaagttaaaaatatttgataaagcagaagatgtatatatctaccctataacccaggaattcaggaattctacacctagatgtataacctaaagaaaccttcctacacatatacaaagaagtgcaaggatggtggttaaaactcttttaaaatagtaaacaattggaaagatctttaagtgtccaaaggagaatgaataaatttcgatatatatatacaatgaaatactattacaagttaaaatgaatcagagctaaatttatcaacatgggcagatttcaaaaacatactgctaaacaaaaagcaaattgtacaatgatatatacagtataataccatttatataaaatttaaaagcaggcaaatgggtatgtatgtatatagtaaaatataaaacatgcatgggtagctgttacctccgtggtaggtagagggggaatggaatatgggaagggcagaaagggagattcaactttatctgcaaccttttatttcctttttaaaaaatctgaagcaaagttgtcaaaatgttaggattaataaagtaatactttaaatattgaaatattgaatttaaaattaatttaaaagaaaggctatatatccattataagtctcatgtagcagtcactttttaatcatccaaattagatagtagtctattggcataatggcctctctttgtgtctaggtgtgtatgtttctgtttctcatctaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcractcccgagacatcttccctgtgggctggtgttccttgactggagacaacctgcagcctcctggcaccaaaggtaaaggcccatctacgtgctcttgaaatcaggacccagatgataagggagactacccagggctgtcatgatcatatcttcaccagtatayttcactagtatgcaggggaggagcaagggccagcagcttaggtaaaaacccaggtctaccagggagcaattagaaacagttaagtattaagtgtcaaatgaaaccgcatatggcatttgggataaagtaataattctttgctctacatatcctggtttattctcaggcaaccagcttttcatctctcttacttttgtccctaacccattacaaagtttgagtactagtattcccaaggcacacaccttcctctgaccttaggggctttggataaaagctggagtaacactgtattgtaaaaatagttgagaagcactgtagcaggatggaaaaagaacaagctttgaagtaagatagacatgggtttgaggtccatctttgccttttatcagctgtgtagctttgggcagttaatttacctccttaaactacaaattccacatcatgaagtagaaaacctactttatgaagttattgtgaggaataaatgagattacatgggtaaaatgcttacatgaaaagttgatgactagcaagtactaaacaaatttttattgtattactgctgctattatagttatattctatattataactatatcatattatactatatgattattacaatatgctatattatcattattataaaactaaccactaccwatgagagagtatatataaagtactagaatagtgtcacagactaaatgaacaataaaatgatacagatgatgacagtggagaagrtccagaatagattttgaggtagctgcttttagtaaagataataataataatctcatcctcttaagtctaaaaagtactggtgaatctgagggaatgaaaagtcacccttcttattgtctgaggatctttttctaaacctctgttgaattcattcattcaattagccaaatatttattgagcacctaattgtaagccaagctgagagtacacaagtgacaaaaatgaacaacattgctgtgctcatgacacctccattctagttgggtgaaacagatggtaaacatttaaatcaagaaataagataatttcatatagataatttttatagacagaaataaaataatttctcctaaggaaataaagtatgatgggatagtgacagtgaaggtataattgtaaagggttttttttgtttaatagccctattgaaatataattgacataagataaatggcatgtatttaaagtgtacaatttgaaaagttttgacatctatatacatccatgaaaccattaccacaatgaaaataatgaacatatttatcattcacaaaagttctttgtagaggggaaacttgtttaggaagaatttcttttcaagaaatttgtctgaaaagttgatacttgaattgagacctgaatgatgagaaggagtcatccaaggaaagagacttccaggcaggcagaaggaacaactaatataatgatgctgagacatgagtgagtttgctgtgttccaagggcagaaagcagactgctgtgactagaatgcattgcctgagcaagaaagtggtacaaggggctgggtgcagtggctcacatctgtaatcccagcactttgggaggccaaggcaggcagatcacctgagctcaggagtttgagaccaccctggccaacatggtgaagccccatctctactaaaaatacaaaaattagcaaggcgtggtggtaacacgcctgtaatctcagctactcaggaggctgagggaggagaattgcttgaacctgagaggcagaggttgcagtgagccaagatcgcaccaatacactgcagcctgggcgacagagcragactctgtctcaaacaaaaacaagcagtgcaagatgatgttggagaagtggrcaggtgccaaatcatgtaggaccttgtaaaccagagtgggaatattggattttattctaaacatattagggaaccattagaaggtactaagccagggaagtgacaagatttgatttactttaaaaaaatcacttggacttgtatccagaatataaaagaacacctataactcaataataaaaaagacaacccaatttaaaaataaggaaaggatttggatagatatttctccagataacatacacagatagccaataagcacttaagatgctcaatatcattcatcattagggaaatgcaaatcaaagccacagtgaaatacaacttcacacccatggatacagctataagcaaaagacagataataacaaatgttgctgagaatgtggaaaaactggaattctcgatcattgctggtgagattggaaaatgctgcaaccactttagaaaacagtttggatgttactcaaaatgttaaagagttaccatgtgacccagtaagtccactcatagatatatacccaaaagaatagaaacatatgttcacacaaaaacacataatgaacattcatggcagcattatttatagtagccaaaaagataaaacaacccaaatgttcatcatctgatamatggataaataaaatgtggtatagctagaggacaaaatactaattggcaataaaaaaggaataaagtactaatacatgctacagtatagatgcatcttaataacattatgctaaatgaaaagccagtcacaaaagataatcattgatgattacatttatatgaaatgtccagaattggcaaatacacatagacagaagtagattcgtggttgccagtgactaggggagggaaaatgggaaatgactgctattggggtttcttttgaggataatgaaaatgttttaaaattagggatgatgtttgcacaactctgaatatcttagaaaacacaaatgtagggtgaatttgtggtatgtaacttatgtcaataaagctattatctaaaaaaaattacttgagctggtctgtggagaatgagttgtacagtggtaattgtggacaaggaagaaatgaggttgcttggattaggatagttgcactgaggtggagagatcctcgggcagaatgaaagggaaacacacttcttggctcaggaaagtgccactcctctctgtgatgcaagaaacaagtaccctggggtcagtatggtaaatgcattgtgaggaagcactgtgaggtaatagctctgtggaagcagcaagaagcgaggtaccttgraactgatagcagagtcatttttgttacttgaggctaaaacaggataagccttggtgctctgggctttattcagttaataggttgattttctcattttcatgcctagggaattcactgttcttttgactgataaatctagagcagttaggcagttctccagagccaacagagctgacggtctttgtgtccaggttgctggatatgcattcctttttggctgcaaaccttgctgataagaaatatgactcactctgtggctgatgcttccagagaagtttgctgactgttttcctctcttctgtgtctctggagtccttagattttcaacagaagatggtcagaggaccaggctcagaaggtagagagagaccttccaggtgacatttccagaccaggtgcttcagtcatcattccagcagttaggttgttccctctaacaactgtctcctcccacactttacaccctcagtaagtcctacaaaagcgctttctataacagcagaagtttggccagcagtctccatgtcctggctaaggagcaagtgatgcaatgtggaaaaaatgtggttactcaattcatttcacaaaacaagttgttctctgtgtgtaagcctgttctctttctaatcatactatttcctccttctttcctaccttctggtcattagtatgcaaatgttaaaaattcagagtaagataatgtttcctgctcatggcaaataggaaaaaccaatatttatttaatgttcctttacacacagattttcattttatcttctggtaactctgaacaaggtataattattttcagatacattttatttatgagaaaactgaagctcagatmattaaatgacttggctctgttgatatctgagtctagagagtgaaaccatggagatcttttagtagagccacctgtcaggaccaatatatcactgaggcatattgttttcacacttgtctccctgatactcttcccattctcctttggcccttcttcaaagcttcatttgagaccctggattttggcttccaaatcctgataaaaaataggaaagaaaaagtatggtgtartatsagagcactgaactgggttctagtcccagccaggccacaaacttggttacgtcattgagcaagtcattcttacatgtgagaggctgaactacatgatccctagtgggcacttttacctctgtaatactatctagtttaatgatcttgggaataggtagcaggtgactcctgtgcctctgtctcctacatgattttaggttcatcagctcacctatcacctatctctgcctttttgaagtaattcctgtgtgccagctgtctgctgcctctctttttctccttttctaagccaagtagtatcccttttagttgctaaactcctgtggccaagccaactctgatgggtagtaactaccaagcgtccaactaatccagagtacttggttataaaaggcagaagctttttacttttagcttattttttgtgacttaaaataaaactgaaacagatacatsctttagtttttaaatgtaaaaagcaaaatgaagaattcagtacatatggcatgactatgatgctaatcatacctttagccatcatgataatccacttgacttccccttgctctgatttcaggctgggaaagccagtttcagattataccttagctccctatgtggattgatagcagcgagacaacatgagacccargctactttatatttttattataaattaatatattgctattctggattagtacattcgtctcttgtgacttcatatgttgttaaactggatctgtctgctgtctacatgctaatccaaatatgggaatctagtagaggtgctgcactttagcatacctgttagagtacatggtcaaccaggcctcctttaccctctcagtctaccctttctacctgcgacaggtttctttgtacaaagcaaaaatttcaaaatcggactcaacatcgtggctcacgtacaggattcttacactggtctggagggtaataatttgaygcttaraaacaaaactttcagaatatcttttcctttttttatttggaaagtgctttccatacttaaagaatgttctctttttgttttaaaaccacatacgaaattatgccacaatcactttgggattctagggcagaaagagttaattaaattgtaatcctaggctaggcgcagtggctcacgcctgtaatcccagcactttgggaggccraggcrggcagatcacaaggtcaagagatcgagaccatcctggccaacatggtgaaaccccgtctctactgaaaatacaaaaattagctgggtgtggtggtgcccacctgtagtcccagctactcgggaggctgaggcaggagaatcgcttgaacccaggaggcagaggttgcagtgagccaagatcatgccactgcactccagcctggtgacagagcaagactctgtctcaagaaagaaaaaaaaatgtaatcctagactacagagagaaaaactaggatagaggcaagaataatacaacttaaggctaacttgtaggtctcaacatgaggtcacctgatagacygatcttcctcatccatccatttattcaaattctaactatcaagtcatgattaagtactagtcattggctcagttgatggagattctgccgttagtgtttacagttttgtgaacatatagaccaataaagtacgactttggaggaataaagtacagagggaccccaacctagattgaggggactggaggttggagatctctataacctcccttgagcctagcatgtctaacatgggctgctctatagctattgggtaaatggatgaataaaggacaagacttccaaacgaaggcttccaaatgaagtgatgtctaagctgaaaccttaagaatgggaaggtagagaaaaaattctctctagcagtggaaacagattagtgtagggccagaagttaaaaaaaaaaaaaagtatggtcaaggaattaaaaaatagttaaggccgggcgtggtggctcacgcctataatcccagcactttgggaggcagaggcgggtggatcacaaggtgaagagttagcgaccagcctgaccaatatggtgaaaccccgtctctactaaaaatacaaaaattagccaggtgtggtggctgacgtctgcagtccctgctactcgggaggctgaggcaggagaatcgcttgaacctgggaggcagaggttgcagtgagctgagattgcgccactgcactccagcctgggtgacagagtgagactccatctcaaaaaaagaaaaaggaaaaaagaaaatggctagattgtagkgtgtaagtagaggagcagaaagagataaggcacagcagaggaaggcgcagaatgcttccctcatagaccatcttaaggatctggatttttaccttatgagcatcgagaactgtattaggctgttcttgcattgccataaagaaatacctaagactgggtaatttataaagaaaaraggtttaattggcttagagttctgcaggctgtataaacacggtgctgcatagcttggcttctggggaggcctcagggagcttttactcatggtagaaggcaaagctggagcaggcagatggcagtgtggggaggggggtgtcacacttttacaacaaccagaactcactcactatctcaaggacagaaccacaccctgaggaatccacccccatgacccaaacacctcccaccaggccccacctccaacgctggggcttacagtttgacgtgagatttgggcagggacaaaatatccaaactaaatcaagaactattggctgggcgtggtggctcacacttgtaatcccagcactttgggaggccgaggcgggcagatcacctgaggtcaggagttcgagaccagcctggccaagttggtgaaaccctgtctctactaaaaatacaaaaattagctgggcatggtggcgtgcacctgtaatcmcagctactagggaggctgaggcaggagaatcgcttgaacccaggaggtagaggttgcagtgagccaagatcgtgccactgcactccagcctgagtgacagagcaagactctgtctcaaaaaaaaaaaaaaactatcaaatgggcttttaagtagtagagttacagctcagatttgtgttttagaaggaccattttggcaacaatgaaaggacggattcagatgctggagtcagggatgccagttaacaagctgttataatattccaggtgagagagaaaattgaagcagtgacatggtggtgaggataagatggggtggggggcatattctttgaataaagaagacaaaatgcaagttcttaawgtgtatcacctattgtgactattttatttatttaacaaacaagccctgtaccatgtaaaataatgccaagttttcagtgtaagtatttatgaggagctaaaattcttctttctgtcatgtctaggaagttgggattgttttctacctggagtccatgttaaatggaatgaatttattaactgcctctttatgtccccaccacttggaacatgccatttattcagtaatatctgttaactgaaataggttatactatattttctgattccatttctgttgatcctcatctaaagccrttattcagatattcacttaattacaaaaaataagaatactactcgcatctatgacaaatttgacagattattaaaagctatttaaggccaggcacagtggctcatgcctgtaatcccagcattttgggaggctgagacaggtggatcacctgaggaccagagttcaagaccagcttggccaacatggtgaaaccctgtctctacaaaaatacaaaaaaaaaaaaaattagctgagcatgatggtgggcatctgtaatcccagctacttcggatattgaagcaggagaatcacttgaacccaggaggcagaggttacagtgagccgagattgtgccactgcactccagcctgggcaacaagagtgaaactccatctcaaamaaaaaaaaaggctgtttaatgttacggttttttaattttggaaacctaatggccaaaagtaagagtggcacagggcactaagatttgtttccagagcccatattcactcacctctcagttactaaacacatgtacacctctacacctggaccaccccctgcccttccacccagctttttttyctaataagccacaacaaccaggagggtgtggtctctacaggtttggcagctaatatacccctcttgtctcctgagaaggtgtgttcactagccactagttcagtagttcactgtcagaaaagatatgagcatgttggttaataagtgaagcaaattcttttttgtttattgatatgtaataattgtacattttgatggggtacctgtgatattttgatacatacatacaatgcttaatgatcaaatcagggtcattgggatatctgtcaccacaaacatttatcatttatttgtgttgaaagattgcaaatcaaagctaactttttggtgcctttaatgagaatagccactcaggtactattttccctttaaccctctcagatatattgtgtccagaccttgcccctatttatataccatttcctccttccataaacacacgtatgcatatagtctctgtccttatttcagctttggccttgtgatctcatcacatctggtaaatccgtcctttattcacctatctatccacagttacaggctcatgttagcagtgctaggttcactggaggttatagacaagtgtctgcctccccagttgattgaatgattgaaatgagaaaattggtggcaaatgcatagcaccatgtagcacgtagtagatgcccactgtgcgttagttgcatctgaatcaagatccccaggcctcccaagaaaagggaactgcacgcagagccaggaaagtgctctrttttggtcaggaaaaataaatatgagatgaggcttctgcagtgaaccagtactctcataactgattttttcttggttatatgcttgtggtacacaaatagaaataggaaaatggggaagtgagatgggtggagtagattatgaagyagagaatctgggttctcccactgattgtaattaggtctgcccaagggaccagaaaaaaaaactcccattccatrtctctcttccagaatccttaagctgccccttgactctgcccattcgctctctctcttgccctcacaaactccagatgcctgagaatggtagcagttttcgacatgtataatgaaacaattggcatctctcaagctgtttgaaatagtgagatgtgatttatgcagttcataaatttgaccacatttactgttttcttgggaatacatagaacccatatagggtttttttggcaagcttttattgtaacacccactgtgccagcatcaatacatatcaatttacaraatccccaattttaaataagtgttggtgattttcaggaaaatcttactgaaaaccagtgataaattgtgttactaaatttcttcccttgggccgggcgcagtggctcatgcctataatcccagcactttgggaggccaaggcgaatggatcactggaggtcaggagtttgagaccagcctggccaacatggtgaaactccatctctactgaaaataaaaaaataaaaaaaaattagccaggagtggcggctcatgcctgtaatcgtagcaacttaagagactgagacagaagaatcgcttgaacctgggaggtggaggtttcagtgagccgagatcatgccactgcactccaacctgggtgacagagtgagactctgtcttaaagaaaaaaaaaaaaattttcttcccttgattccctagattatttttgaggaactattacagttataaatgagaatttctgaatctcaataatgacttaatagaaaaaaaacaaaacataaacattcatatatgttaagaagatgagaaaaacctggcaaactcaaaccaagcaaagaaaaaagaggaggttctgagggtgatatggcaagaaggcaggattgtggttgtaagctgttaaaatttattgtcttgtgctaaggaaagctggaatgtttttgactgtgtggctgactagcaggtgctttctcaccatgtgctttcatgccacctttctgagtggcctaagcttgactagccattagcagaccatcttctaagaaaatatagccctccacttgccgaaactgctcctgaatcatcttacctactgccctagaaaactaaggtcagttgcaccttttagtttcagtaatatgaggcttttgaagtttgtggtcctatcatgcatgattttagttatctgttttcccccactctctgcagatttatcagcctgaagtccccaggaaaatgtgacatgtctttgtagttgcagaggtcctctatccatgttgtaggaatgagtcaggagagaaaaaaggagctggatatggagtaccaaaagtgttaactgagctggatcagagcaggaggcaacccatgctgtttaagtgaactggaatttagaagactggagtttcagccttggcatcagcccagctggcagcacatagctgaacccagccaagttgagcaaagctaataaaaaacatatcctctaaattactataccaaggccaatgatacactactgtgaatgaaaaataagattccattccaggaaactgataaaccaaatggattttccccagctctttttttcttttccattgttcatgctctcctatgccatgtagacacacacacacacacatgcgtgtgcatgcacaatagcctattttacattttattaatttattcccaattccctatgctctgttgttgctatagagacgagaaatctgatgataaattcttttgggcagttaagactcctaaggattatttagagaaacctagaaggcagcagaggcctagtgtccttcattattataactaggcatgtttagttctttatcttctctcttttattcaggtatacactagtgttttattcattggtttcagagtaacatagtggaaagaatatagactttggagaccaaaagatctaggttcaactcctagctttagctatgtggcctttggcaagtcttttaacttctgtgagtccagtgtctccatttttaaaatatccaagtatgatagttgactcaggaaaaagcatttgtgcaattgtttgagttgtaagctcaactagctacttttttcatggaatattatctttgcttgaaaaaaacagcggacttggatatttagcagacattttctccaaaatgaaatgatctgatcacttcaaggaaggcaacctataagcattttctgtgaattataaatttaaggtttcaaatgaaaattaaaaattttgaaaaaatgtgtatatccaccagaatgagytttacatcttatcaataaatacagacttcagagttactctttaccatttctctcccatctaaaagttacattggttaagaatcagttatttgccctactattaaatgtgagatgtgaggaaagtaaaaagtcatagagtcttagagtgctggggctagaggaaatcaaattcaacctcccacctaacttaagactcatcttgaaaccatccctataaatgcttatttgctgttacttaaatgctcccacaggcagagattataacctcccaaaggagcacttttaatttgtgatagcacaaatgtctaaaaatactgttttttactgtaagctgaaatatgctttccccagtatctatccattggctctaatttggtttttctttcatccaaaaccttttcacatactcttgtttccctargtctttttttccccgctatttttgagattgtatagtttctaagcccctcatcatcttgagctctcttctttttttttttctccccgcctccccaaccccaggttcagctttgactttagagttttcttttcttgatccatttaagtttacaatgctatgcctagaataaactctagactgcagggacagcctcattagtgtgaaatggagaggcattctgatttccctttaaaaaggactatactggctgggtgcagtgggtcacgcttgtaatcccagcactttgggaggccaaggcaggcggatcacggggtcaggagttygagaccagcctgaccaatatggtgaaaccctgtctgtactaaaaatacaaaaatgagctgggcgtggtggcaggtgcctgtagtcccagctacttgggaggctgaagcagaagaataacttgaacccaggaggcagaggttgcagtgagccgagatcgtgccactgcactccagcatgggcaatagagtgagactccgtctcaaaaaaaaaaaaaaaagaaaaagaaagaaaagaaaaggctatcctatgacctcacatgttaaagataarggattgtgtttttatatttttgtattctgtaatggtcatggtagatgctttacgttactccttgtctagtctcagcgcaagttgaaccaaacttaaagacataatggccatgctagatgaggggattttctggtagttaattttttttgctgcctagggggtagaaatggtaatttataagactgggaaagtacctttttttgttgttgttagagacgagatctcactatgttgcccaggctaagtggaaagtgcttttacarttctcttttatcaccatacccgggttttgataaacttagtattctccttagtaaaagttttcatcagatacttsctcttttttatcttgtgataacttttcttcactcaaatcaatagggaaatacagtatttgctgtataaaaacatagaagcctaccttagagctgaattcactcatttatatataatcaataatcagagtatacctatagacacagtcttattttgagctttccatggaaaagagtgtaggtcaccaggctagaccataaaaatatgtttaaacttttgtttttctcctgtttagtactagattaaactaatcaccttttctaatgttgtttagagcatgtttactgagcatcatcttaagaagaaagaaagttaacatttagcaagcccatacaaggtcctaaagacactttgatacattatctgagtaaacttcacaaacctccagtgggatttatagtatttgcccatattttacataaggaaacgggctcagaaaggttgaggggaagaataagaaactaagatttatggagtccctaggtcatgtcagacacagtactcatatccacattctcaaactttatctcagctaaacttcataataacccataacttaaagaggttatttgcaaggacttgaacctaattccatgggtttctgacttcaaagtcagtgttctttctttcataccacacttcacttctctatgcctcaaaggagatttagagataaccgttaggtaaataaggctgagataattgtgaatatggggtaaattaatgaatgttaaagtactttgagaattatgaagtgtaagtctcatatgataggtttccatctgtgattttggaaatgcatagtgagacctacaggaaattccagggcccttttttaaaccagcagctgggagtttggatgcgtttgaaatgtgtgttgggagtagaatgagaaggattaggagtggaagagagatccttcaaagcactaatgtaatataagatagaaagaactgttgctgatttgattttattctgcatcctgtttagatttgctatatttttatggtgaaaatatatacatttagaattagccagctggactcactttagataatcccagttttgttggcaacatccagagcatcataatcaggagccagtcaaacatctgccttcttctctccctcaggcctgatcagggtgttgaccacatcagtgtcatagagcttctttacaacctgtttgatctggtacttgttgattttgacatccacaagtgtgttgttgtcttctatcttcttcatggctgacccagtggtcaggagggacttaataatggcatagcggtcacgcttatttctttctcctgtgggtgcccttccaaggatatttgggctgcctccagagctgtagtgtcttgggctgccaggttggtgacatgtacatttgtgggctggcggggggtgggggtcggggggaggaagggggagggagggagtgcctgtggtcacttttcagtactgtctttttggccctcaaaggccttgctttggctttggctttgggagggacaggagcttccttctttgtcttcagtgccatcttgtgaaaaaagagctacatctgtatattttttcagaaccataaaattctcacagaattttcaaaatgacctttttagcaatttactgtcacttcacttaacctcccttagcaaattatttaacttccattagtctttgtttcttcatctataaattgaggcagtaacagtacctactcacagggttgttgtaaggagttaagaatttacatattagaacacctggcacatattaagcattcaaaaaatgtgagttattttctattttaatgctgttattttgtraataaggaaattgaagcctggtaaaaggtcactttctcaagttttacttgaattagctaccaaatgatatatgttgtttgtatgataataaataaggtgagtctttcataagtagtatttaaaagtttcagtttatgtgtattacagaagcaggtgcttgtgaaatagttgtcaaaatagaatgaaatatttaagagttacccagaaatatataatatataaagctcaaaataatactaatagagactgagtaggtgaaaaagagggaagactggatagaacttattgggatttgtgtcatttgctgaaggatgtttagagttgataaccagttcragaggcaattaattccagggggctaacatgcaaggcaccagctaagaaaaagaatcgttccaaaaacttaagcacagagactatgtcaagaaactgaaatcagacaaggtgaaagaatagcacggcttattctgaatttacacagaaaatattacaaagagactattgaagaattttaaccaaaggagtgacatgatcacatttgtgttttagacagatctttatgacctgttagataaggaatagaggtaatgatgggttagaataagttagagggagagagactggttagttcaccatttcagtgattaagacaagggattttgaggatgtatattaaagttgaggcagtggtattkgagtggaagaaatgaatttgattagctagctgtggtggcacatgcctgtagtcccaactacttgggagactgaggcaggaggattgcttgagcccaggagtttgaggctacagtgaactatgatcgtgccactgcactccagcctgggtgacagagtgacaccctgtttctaaaaaagaaaagaaatgaatttgagacattcgggagacagtttctctggaaaagacattcttttttgagccrcattcctttaagctttcagtactagaggatcctaaaactagaagcagactaagatcaaatgctagggaaaccgtggacttgatgccaaactaagcaaaaagaataaatgctgagttggaggtagaccgtgtcattagcagaatatgctagatctaaacatgaacaaccagaaagctaagtctgaaatcagtcagcagagttgcaaattaagaagactagttgtccagatgagtttccagtaaaagataacaatttctcctaaccttaaaggccaatactctgagccagtatctgacaaactaacttgatttctagatatacattttacttcaagaacactaaactaattatccatttattattttaggtaaagtatttttgcccttttgtatacttagacatattgcacattgccaaaactggagcagaactgaagggccccagagtgattaaaaactagcatgttctttgaactagtttgaaagactggaaattgctgctaatgtgtgtaatccctttagcagctggtcccatctaatagcccagttactgcctgtgaagtggtaagcattaggattgtttcatactaattattagcatgagaagaatgagaaaaaaggtagggaaaggagaaagaaaaagatactagcctgtctgcactttgtgtagtcatgttggtccactatggccatagaacaggattccctttgactgtatcctctacaggagcagagtttcagggtcccagaacaattagggtcaagagtatcattttgccgtagttgcctgatgagtgttttmtttcttttcctctccaatctaccctgctcttcacctcccacrtagcaacatagtagcagaaagttcactacagtcagatgagaacaaggctaaggtttattgagcgttcactatgtagccagtgccggactgatctcttcaattgttatttcatgtaatcttgacaataatctgtaggtaagtactattatctattttacaaatgaagaaactacaatgcagagaaatgaagtaacttccttaaaatcacacaccatgttcaaatgtccagctccacctttgctatttatttcctgggagatcttaagcaagtatttttcctctataatgtttagtttctccatctattttttaaaaaggttaaactagatgacataaggttgcttccaactttcagtattctaagactgtgttgggtaaatcattccgttaataattgtaataagtcataaaagttcagtgtctgttcctattattgctagtattattgaatctagtgttaacctgagcttcctaccttcctaacctcttttgctattgttaacattttgtatattctattctggtttttattttttacagtttttaaaaatgcagtttaatcacactgtatattttactgtatgctatcctattctgtttttcactaaatattatctatcttgttctgtgttgttatacaatctttataaccatcattttaagttattatgtaagagtcaattgaatggatatgcaattgtttgcttaattattcccctagtttaatggtccaaattttcttttttaataatgatatgataaacttacttaagcatttttctcaatgccaaggaacgtatccttagtttcccagaaatacaagacggtgtcaaagaaagaatatttttaagaatcttggctgcacagagccaaatctgctcatttgaaatatatatattcgcatgttcaaccaagaatcatctgcttaaaatcgaccagaatatagcatcagaatggcacattttcctgcttccagcatatttttatatagaaaacatagaccccaggagstaggaggtcagcactgtcatataccagttacaacattcataactacagtagaacttattacaaaccagaggaaatatgtctaatttttttcccagttttcactgcccaatacgtgtgctgtcacttgggaataggttttactcagaattgtgactgtgggactgcaaatattccctaggaaaaagactgcacatagtatatccaaggcccaaagctttggggactacatggaatataggttagcctctgttttgagaatttgtagtctgctagggaaataaaacataaaccactgaaaaagcagtcaaagtgaagcagaattctagaatcaaatgctagagtatgggttacatttattcactcaactaacatttattgagcacccaccatgtgtaaagcataattgtaagatgtggacataacaacatagtccttaagaagttgtattctagttgagagagacataaacaggtaaactggtagcgataatttatctggagaaaaaataaagacaggtaaagcagaagaaggagaatagagagtgccaggggtttgggggtgatgggttggaggtattgttttatataggatgatgagggaaagcttcactgaaaggtatcatttgagcagagatatggctgtctaggaaaaagaatttttwttttttttttgaggcagagtctcactctgctccacaggctggagtgcaatggtgcaatctcagctcactgcaacctccgccttctgggttctagcaattctcctgccttagccayctgattagctgggattacaggcacctgctaccaagtccggctaatttttgtatttttagtagagacggggtttcatcatgttggccagrctggtcaaaacttctgacctcaggtgatctaccagtctcagcctcccaaagtgctgggattacaggcgtgagccacgatgcctggctcttttttttctttttaaaaaaattattttatctaccactaagagrgagaaagaaattctttcttagtaaagagagttgaaagtttaagtgcaccaaagcaatagtttgcttagtttaacaattctcaaactgtactccttggatccttgggatccccaagaccctttcacagcatcttcaaggtcaagaccattttcataatgttaactctacttgccttttttactgggttaatatttgcattgattggtataaaagcaatggtaagtaaaactgctggcaccttgacacaaatcaaggcaccaactatagtaatagtaatgatatacttgattgccacatgttgcagggggaccaaaacaaaaccaaaaagcaactcgggcataagccaagttcacttaacagtgtccttgatgaagcagtaaaatttattaagcttattaaatcccagcctttgagtagatatcttaacattctttgcgatgaaatgagaagtatgactagtgcaattctggtgcgtactgatgtactgtggttgcctgaagaaaaaacgcttgtataattgagctgtcagctgaactagctacttttttatgaaactccatttttacttgaaagaatgactaacaagacaaactcgttattcagatttgggtgtttggcagacattttctcaaaaatgaactaagtgagcctgtcactttagagaaaacagctaatagcatttgttagcaatgataaaattcaagctttcaaatgaaaattagaattttggaaaccttgtgcctgccaccataatcttgacagcttccccgtacttaaagacttttctgatgagattgtggtgataccaactaatgtgtatttttgatactgaataataaaatatgctgatatttgggaaatctgtataactcagtgaaacagtgttttacaaatgaccaatgcatgatattacaaaatcaggcatggattaaaaattcattcaaagtacaagatagactaaaagattttaatattaacagaatatgaaaagtttattagtattatttcaactttcacattttgattaactttttttattattattatactttaagttctagggtacacgtgcacaacgtgcaggtttgttacatatgtatacatgtgccatgctggtgtgctgcacccactaactcgtcatttacattaggtatatctcctaatgctatccctcccccctccccccaccccatgacagccccgtgtgtgatgttcctcaccctgtgtccaagtgatctyattgttgaattcccatctatgagtgagaacatgcggtgtttagttttctgtccttgcgatagtttgctgagaatgatggtttccagcttcatccatgtccctacaaaggacatgaactcatccttttttatggctgcatagtattccatggtgtatgtgtgccacattttcttaatccagtctatcattgatggacatttgggttggttccaagtctttgctattgtgaatagtgccgcaataaacatatgtgtgcgtgtgtctttatagcagcatgatttataatcctttgggtatatgcccagtaatgggattgctgggtcaaatggtatttctagttctagatccttgaggaatcgccacactgtcttccacaatggttgaactagtttacagtcccrccagtagtgtaaaagcattcctatttctccacatcctctccagcacctgttgtttcctgactttttaatgatcgccattctaactggtgtgagatggtatctcattgtggttttgatttgcatttctctgatggccagtgatgatgagcatttyttcatgtgtctgttggctgcataaatgtcttcttttgagaagtggctgttcatatcctttgcccactttttgatggggttatttgattttttcttgtaaatttgtttaagttctttgtagattctggatattagccttttgtcagatgggtagattgcaaaaattttctcccattttgtaggttgcctgttcactctgctgatagttcttttgctgtgcagaagctctttcgtttaattagatcccatttgtcaattttggcttttgttgccattgcttttggtgttttagacatgaagtccttgcccatgcctatgtcctgaatggtattgcctaggttttctcctaggatttttatggttttaggtctaacatttaagtctttaatccatcttgaattaatttttgtataaggtgtaaggaagggatccagtttcagctttctacatatggccagccagttttcccagcaccatttattaaataggaaatcctttccctatttcttgtttttctcaggtttgtcaaagatcagatggttgtagatgtgtggtattacttccaagggctctattctgttccattggtctatacctctgttttggtaccactaccatgctgttttggttactgtaaccttgtagtattgtttgaagtcaggtagcgtgatgcctccagctttattcttttggtttaggattgtcttggcaatgcgggctcttttttggttccatatgaactttaaagtagttttttccaattctgtgaagaaagtcattggtagcttgatggggatggcattgaatctgtaaagtaccttgggcagtatggccattttcacaatattgattcttcctatccatgagcatggaatgttcttccatttgtttgtgtcctcttttatttcattgagcagtggtttgtagttctccttgaagaggtccttcacatcctttgtaagttggattcctaggtattttattctctttgaagcaattgtgattgggagttcactcatgatttggctctctgtttgtctgttattggtgtataggaatgcttgtgattttgtatcctgagactttgctgaagttgcgtatcagcttaaggagattttgggctgagatgatggggttttctaaatatacaatcatgtcatctgcaaacagggacaatttgacttcctcttttcctaattgaataccctttatttctttctcttgcctgattgccctggccagaacttccaacactatgttgaataggagtggtgagagagggcttcccttcttgtgccagttttcaaagggaatgcttccagtttttgctcattcagtatgatattggctgtgggtttgtcataaataactcttattattttgagatacatcccatcaatacctagtttattgagagtttttagcatgaaatgctgttaaattttgtcgaaggccttttctgcatctattgagataatcatgtggtttttatctttagttctgtttatatgatggattacgtttgttgatttgcgtatgttgaaccagccttgcatcccagggatgaagccagcttgatcatgatgtataagctttttgacgtgctgctggattcggtttgccagtattttattgaggatttttgcatccatgttcatcagggatattggtctaaaagtgtctttttttgttgtgtctctcaactaacatttttttttttttttttgacacggagtctcgctctttcgcccaggccggagtgcagtggtgctatcttggctyacagcaagctccgcctcccaggttcacaccattctcctgcctcagcctcccaagtagctgcgactacaggcacccgccactgcgcccagctaattttttgtatttttagtagagatggggtttcaccgtgttagccaggatggtctcgatctcctgacctcatgatccacccgcctcagcctcccaaagtgctgggattacaggcgtgagccaccgcgcctggccttcaactaacatttttaaagaaactaccacttgctgagtttcagagtgagctttttaatttttttaacttttaatttaaaaaattatttttaattgtaggtatgtaattgttatacatatttatggggtacatgtgatattttgatacaggcatacagtgtgtaaggattaaatcarggttattgggatatcaatcacctcaagcatttatcttttttttttttggtttagaatcaaaggagaatatccacaattacctgaaaaggttatttcagtactcctcccttttccagctacatatcccatgagtctggagtttctttgtaacttcaaccaaaaattacgtatggcaacagattgaatgcagaagcagatatgagcatctaactgccttctgttagatcagagatgaagagatttgcaaaaatataaaataatgttcttttcactaaacttattgttttggaaaatataatttcataaaaaggtgttaacatgtttgtgttaacttaaaattcatattgtatctaagttttaatttctaatatgataaatgttgatagatacaacacataacaactctttgtggacctccataaattttaagagtgtaaagcggtcttgacaccaaagagtttgagaatcactagcaaaaaggacaatattggccaggcatggtggctcacacctgtaatcccagcactttgggagagtgaggcaggtggatcagttaaggccaggagcttgagattagcctggccaacatggcaaaacctcatctctactaaaaatacaaaaattagccaggcatggtggcacatgcctgtagtcccagctactcgagaggctgaggcacgagactcgcttgaacctgggaggtagaggttgcagtgatctgagattgtaccactgcactccagcctgggcaacagagcaagactctgtctcaaaaaaaaaaaaaaaaaaaaaagagacaacatggttagagtggaataatcaagggagagtggtaggaagtaggtcagaaaaataatgaggaatcagatcatatagggctccaaagttcagcataaggaccttggctttagttctgagtgaaaggggaagctattgaaggttttgagcaaaggaatggtgagatctgaagcatgttttaacaggctcactctggtagctgtgttcaaattagagtagaggagcagagacaaaccattcaaaaggcttattgtaaaaacccaggttagagatgatggtggcttaggccaaagaagtatgaaggggacttatgaaaaacgatcagattgttaatacattttcaagttatagctcatggactgctaataggacaggaatataagaagaagagaggggtcaaggacaactccaaggtttttagcttgtgccatttgaaaggagatagagaagtcttgggaagaacaagtctatggactgagataggtgagtcagaacttcagttgcagatatactatgcttagaatgtctaatagattttcaagtgggaaattgtattaaaaacaagaagtttaagggaaatttctaagctggtaatataaacttggaagttttaattataggtagaatttaaagccatgaggctagaggagatcctagggttgtgttctgaaaatgtggtccccagaccagcagcatcagcactgcccagaaaagcaaattcccagacctactaaagcagaaactcagaggctggggctcagcaatctgaattttaacaagccatgcagactaaagtttaagaaccacttacctaaggactagagtgtagacagagaagagaaatctgttcaatgacactcctgggacatgcccatcatttacaggttggtaaatattttacatctcccctttttctacagtatgaatcttagtttccgccaacatcctataatacacataaaataagtttcagaattctatatgcataccactatggaaaaactcttagaagagttcaagatttgtttacgtttttttcctccttagatggttaaagtacttaaagtactctgttcaaaaattacttgaattactttttttccttcagtgtaattatgttattcatttaaaacacagttgtgaattagccaggcatggggacacacatctgtagtcccagctagctactcaggaaactaagctgggaggatcgcttgagcctaggagtccgaggctgcaacgagttatgattgagccactgcacaccaggctaggtgacagagtcagaccctatccctaaaaaaataaaatatagttgagtttatttgttcctgtttgcattcagtttaaggttcagtttttgtccttatctttatggatttaattttattttttgaatatatagaaaattaacttgcttccaagagtcaaaagtcatacaaaacatttactaagagaagtatcgtccaccctttctcttctaccttattccttccaccaccactaccctctttaagcaatcactttcactattttctggtttatcctccaatgtttcattttacaaaagtaagcaaatttatgtgtgttttcctacccttcttacacaaaagttagcatgctctatattctcttttgtactttgctttcttcttttacttaacagtataccctgggagtcactcctttgcaagttcacaaagatctcccttattctaagctgtagactactccattgtgtatgtgtgtgtgtatacaatcaatatagtttctggtattttacaattacaaataatgctaccattgcataaataaatacacacacacacacacacacacacacaccagaaactatatatattgtgtatagattattatatatagtatattgtacartaatatgtaatactgtatatgtattgcttaataaacttgtacacatgtattttcatatttggaggtgtatcttcagggtaaatgaccagaagcggtattcttgggtccaagggtaaaggcaaatatagttttgttagatactgccaaattcccttccacagagatgctaccagttttcattctcaccagcaatgtgcttgttttcccgtagcctcaccaacagagtatattatcaagcttttgacttttttgccaatctgatgggtgagaactggtttctcaatataattttaatttgcatttctctttttatgagtgaagtttaacatcttttcatatgtctagggtgccattttatcttttttttttcttttacaggttgtcatttcttttgctcatttacccgtgtgattataggtcttttttcctctcaattttaaaagtcctttgtatgttagatacacccttttattgtaacatatatcgtaaatattttctcccaatttgtactttgcttatggtagtttttcatttgtttctcatgcaaaagttttaattttatagttaaatttattaacctttcattataggaattcacctatattttcctctagtacttatatattgtttttcttttttattgttacatctctgatccatttggaatttattcttgtatttggtgtgagaaatagatctaatttgtgtttttccagtggccatccattgttccactatcatttattaatgtcttcatctttgccctagtaatttgagatactgcttttatcatatcccagatttatgtgtatagttgggtctgtttttctattccattggtgtgcctgtccattggtgtaccagtaccacagttttcataatagaagctttgtattttaatgtctgctaaggctaattccctcagctctcacattctgttgttttcttagttattgttatggtttctgctttgtgtgtttggggttttttttttttttttggttttgttttgttttttgaaacaagggtctcattatattgctcaggctggtctccaactcctgagctcaaacratcagcttcccaagcaggtggtactacaggtatgcactgctgcacccagctagtttgttgttgttgctgttgtttagagacagcatcttgctatgttgcataggctggtcttgaattcctagcctcaagtgaccctcccacctcagcctcctgagtagctgggactaccagtgtgagctacagtgcctggttgtggttttttttaatacatacaaagtttaatgtcaacttatccagctccaggggcagggcagggcaggggcagtggggaaaggtttctttgtatttttattgaggttgcattaagtttgtaagttaacttagaactaacaacttgatgatattgaaaaataaaagaacaaggatagatgtctttttgtcaagtctacttgtgtgtctttcagcagtgttttgtaattatcttcatatggatttttcatatttcctgttaactttgttcctgagtatttctgcctctgttacattatctaactgatttgctatayatgaaggctgttragttttgtatgtcagttacgtattctgttaccttgctcaattctttcactgtttgagctagcttcatcactgattttatagggatgcactgtccaatagaaatgtaatttgagctatgtacataattaaaatttttgtagtacattttwaaaagaaaggctgggcgtggtggctcatgcttgtaatcccaacactttgggaggccaaggcgggcagatcacaaggtcaggagatcgagaccatyctggccaatgtggtgaaaccctatctctactaaaaatacagaaattagctgggcgtggcggtgggtacctgtaatcccaactactcaggaggctgaggcaggagaatcgcttgaacccaggaggcagaggttgcagtgagccgagttcacgccactgcactccagcctgggcaacagagcaagactccatctcaaaaaaaaaaaaaaaaaaagcaggtgaaattaattttaatactatatttaatccataatatccaaaacattatcatttcaatatgtaaycaatataagacattattagtgaaatagtttacattctttttctactgtgtcttcaaaatccagtgtgcattttatatttacagcacatctcagtttgaactagtcacattgcaagtgctcaggagccacatgtgtctagtgcttacttttttggatggcgcataccctgtcatgtcatctacaaatacagattgttttactttatcttttccaattcttaggcttctaatttgtttctcttatctttaatactttggttaatacctccagtgcaatgttaaatattagtggagctagtaggtatcagtactttattcctgaccttagtgggaatacctcttgtgtttctccagtaagatgtttcctttaggattttggcatatatgtattatcatgttaatcacatagcaaactatttatattttcttgagtgcttaattttgtcaaaaacctttccagcattaatagagtcatcacataattttttttcttagacctattaataaggtctgttgattgatttcctaatattgaattatctttgcatttatagtatagacccaacttgttcgtggtagtctcttaactctttttctttttttgctttttcttgttttttattttattttatttattattattattatactttaagttttagggtacatgtgcacaatgtgcaggttagttacatatgtayacatgtgccatgctggtgtgctgcacccactaactcgtcatttagcattaggtatatctcctaaagctatccctccyccctcccccaccccacaacagtccccagagtgtgatattccccttcctgtgtccatgtgttctcattcttcaattcccacctatgagtgagaatatgcagtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattgatggacatttgggttggttccaagtctttgctattatgaatagtgctgcagtaaacatacgtgtgcatgtgtctttatagcagcatgatttatagtcctttgggtatatacccagtaatgggatggctgggtcaaatggtatttctagttctagatccctgaggaatcgccacactgacttccacaagggttgaactagtttaccgtcccaccaacagtgtaaaagtgttcctatttctccacatcctccccagcacctgttatttcctgactttttaatgatcgccattctaactggtgtgagatggtatctcattgtggttttgatttgcatttctctgatggccagtgatggtgagcattttttcatgtattttttggctgcataaatgtcttcttttgagaagggtctgttcatgtccttcgcccactttttgatggggttgtttgtctttttcttgtaaatttgtttaagttcattgtagattctgaatattagccctttgtcagatgaataggttgcgaaaattttctcccattttgtaggttgcctgttcactctgatggtagtctcttttgctgtgcagaagctctttagtttaatttgatcccacttgtcaattttggcttttgttgccattgcttttggtgttttagacatgaagtccttgcccatgcctatgtcctgaatggtaatgcctaggatttcttctagggtttttatggttttaggtctaacgtttaagtctttaatccatcttgaattaatttttgtataaggtgtaaggaagggatccagtttcagctttctacatacggccagccagttttcccagcaccatttattaaatagggaatcctttccccattgcttgtttttctcaggtttgtcaaagatcagataggtgtagatatgcggtgttatttctgagggctctgttctgttccattgatctatatctctgttttggtaccagtaccatgctgttttggttactgtagccttgtagtattgtttgaagtcaggtagcgtgatgcctccagctttgttcttttggcttaggattgacttggcgatgcgggctcttttttggttccatatgaagtttaaagtagttttttccaattctgtgaagaaagtcattggtagcttgttggagatggcattgaatctataaattaccttgggcagtatggccattttcatgatattgattctacctacccatgagcatggaatgttcttccatttgtttgtgtcctcttttatttcattgagcagtggtttgtagttctccttgaagaggtccttcacttcccttgtaagttggattcctaggtattttattctctttgaagcaattgtgaatgggagttcactcatgatttggctctctgtttgtctgatactggtttataagaatgtttgtgatttttgtacattgattttgtaacctgagactttggtgaagttgcttatcagcttaaggagtttttgggctgagacaatggggttttctagatatacaatcatgtcctctgcaaacagggacaatttgacttcctcttttcctaattaaataccctttatttccttctcctgcctaattgccctggccagaacttccaacactatgttgaataggagtggtaagagagggcatccctgtcttgtgccagttttcaaagggaatgcttccagtgttggcccattcagtatgatattggctgtgggtttgtcatagatagctcttactattttgagatatgtcccatcaatacctaatttattgagagtttttagcatgaagagttgttgaattttgtcaaaggccttttctgcatctatygagataatcatgtggtttttgtcgatggttctgtttatatgctggattacatttattgatttgtgtatattgaaccagccttgcatcccagggatgaagcccacttgatcatggtggataagctttttgatgtgctgctggattcggtttgccagtattttattgaggattttcrcatcaatgttcatcaaggatattggtctaaaattctctttttttgttgtgtctctgcccggctttggtatcaggatgatgctgtttggcatgtttttggcatgtttttgcagtggctggtaccagttgttcctttccatgtttagtgcttccttcaggagctcttttaggacaggcctggtggtgacaaaatctcttagcatttgcttgtctgtaaagtattttatttctccttcacttatgaagcttagtttgtctggatatgaaatcctgggttgaaaattcttttctttaagaatgttgaatattggcccccactctcttctggcttgtggagtttctgccgagagatccgctgttagtctgatgggcttccctttgtgggtaacccgacctttctctctagctgcccttaacattttttccttcatttcaactttggtgaatctgacaattatgtgtcttggagttgctttttttcattttcttaatgtcctttgattaagagaaatattttgttttaatgaggccatatatatcttcactctttgataattagtgctttttgtgtcctgttttaataaatctttggccgcccccatagttttgaaggtattctcatttgtcttctagaaatttgatgttttagccttcacattaatttttgtatctggtgtgaaatagaactcaagtttaatttttttccatatggatacctatttgactcaccacagttttattgaaaagaccattttttctctccacagaattgcaagggcacatttatcataaatcagatgactatatatgtgtagttaattttggaactctctattttgctctgttgattcattcatctacccttgcaccaataatatatgtcttttttttttttaagacagagtcttattctgtcacctagactagagtgcagtgacaccatcatggttcagtgcagccatgacttccagggcttaagtaatcctcccacctcagcctccagagtcactgggacyacaggtgtgcaccaccatgcccagctaattttttaaaaaatttttgtagagactgggtcatgctatgttgcaaggctggtttcaaactcctggcctcaagcaatcctcctgcctcagtctcccagagtgctggggttacaggcatgaaacaccatgcccaacaaataatatatgtgtcaattactgtaactttataatgaatcttgctatttgatgatgcatgttctccagctttgctgttattcatcaagattgacttggctactataggtcctttgcatttcctattaaaatttagaattaaattgtcaatttgcatacatacaccacacattttttagaaactgctgagatttctattggaattgcattgactctagatcagtttgatgagagttgacacctaacagtggtgatgctttcaatctatgaatgtaacatatcccttcatggccatgtgatatctagatcttctttaatttcccctatcaatattttatagttttcagtgtagatgtcttgcccatctttcactgaatacttgatgttatttgattttgtggatttttaaataattttcaaattgttgctatttagagaaatacattagatttttaaatattagatttgtatctagtgacctttccaaattcatttttttattttaatagattttgtagacttgtaaggaggaatatttatgtaaacaatcatgtcacgtacaagtaatgcttcttcccttacagtctgtatttatagattttatttcttttcctttccttattgcattgacctccaatacaatgtcgaatagaagtggtgatagtagttattttgttttatcccataattcaataagaagtgttcaatatttcaccattaagaatgctgttgattataggttttttatagatgcgtttatctagactaaggaaattctcttttattcctagtttattgataatttttatcatgaatggatgttgaattttgtcaaatgctttttcttcatctgttgagatgatatataggttttctctttcatttagtgaatgtatgtgttcagcggattgtattttccattgttaacctttgtatttctgaaataaatcccacttagttatgatatattatcctgcatgttatgatatgatatatataggattgtatatctgatatacatatagagagagacctagatttaatttacaaatactttgttaaagattttggatgtatgttcatgagggatattagtctatagtttttttttcttgtaactatctttgtcatgttttggtatgagggttatgctggccttataaaatgaaatgggaagtgttccctcttctatttttcaaaagaggctttgcaagatttgttattatttcttctttaaatatttgctagaattcatcagtgaagccagtttaggcctgggattttctttgtggaaagatttttaattgcaattgcaattttttattatgtatgaggctcttcatattctgtttttttcttgtgtcagtggtatttttgctttgttttgtgttttaagagagagactcatatattatgtaaataatggaacaaacaaacagattttttaaaaatcataattaaaatgttaaaatgtaaaaaagatgaacaaagtgtaagaaaaaatagtacccacagaaatatctatataaaaaattaaatggacatcttatacctaaaaaatacagtattaggaataactcattgcatgggtttaagggcagacaagagccaacagaaaggagtaataaacttgatgaaaaaatagaaaatatccaaaataaagtacagtgagaaaatacaaaaaaaatttagagcattagagataagagatagagcctgtaatccaggctgaagtgcagtggtgtgatatagctcactgcaacctcgacctgggctcaagcgatcctcttgagtagctagggctacaggcacacaccatgctcaactaatttgtttttgtagagatggggtctcacagtgttgcccaggctggtcttgagtgacattttatctcaattttcatatttaattggcataaagttattcatactgtcctgttctctacccaatgtctgatggatctatgatgaaattgtctctgcgtattctatatttattaggtatatgtatcagttaggttggttggttaattggttattcatgttattagttttctttcggttagtgtttatagagtacattattttcatctgtttgcttttctcttcctgtgtttttatattttgagtgtctttgtatctcarggccctcttataaacaaatataattgagttctgggggttttttttggtctggtttgttcatttattcctactgactgttttacttaatccacccttctttaataaaattatttatttgggtttaagtcaacattttgcattttgcttttttgttttctatttgtccaagttcttccttatttctttattcctcctttcttgccttcttttggattaatcaagtatgttttattattctacttctctccccttagctttttagtaatgcattcttatccctgataattctttaattaattgccgtatgcaaatatgcatattggacttattaaaatctaccttaaataagtgctctaactactcccaaataatgcaaaattcttaacaaagtttggctccatttactctccactttcatcctctgtgctattactgtcacataacttattaatacatatattataaacggcacaagccatttttattattgttttaaataatcagtatccttttgtatcaactcacatgtttaccctttctcgtgttcttcatccttcctgtagtttcatgtttccatttggaatgtccttcagcctgaagaacttccttttcattttccatagttaggtctgctggtgacagattctctcaactttgattatttgaaaatctcattattttacctttatttctgaaggatattttcactgggtgtataattctatctttggtagtctgtttcttttagccctttaaggatactattctacttcttcttgcttacamagttttattaaagagcctgctatcactcttattgttgctccggtaatgctgtttttctctctgactgctttttaaaatatatctttgtatttcctccctgtcttttatttcatctgtatttcatcttttgtattttcagcagtttgacaattatgtgttttggtatcgttttctttgtatttttcctgctatggattgctgaatccataagcatcctgaatctgtgggttgatgtctttcattagttagagattaagtctccgctgttaccttttcatatattgctttttcttcattctatctgtcttctccctgtgggattgcagccactcatattttggacctattgactgtgtctacttaatctctaatgctctaatatattttttcatattttctcactgtactttattttggatgttttctattttttcatcaagtttattaatcctttctrttggctcttgtctgyccttaaacccatgcaatgagttattcctaataytgtattttttagttataagatgtccatttagttttttatatagatatttctgtgggtactatctaccttttcttatattttgttcatcttttttacattttaacattttaattatgatttttaaaaaatctgtttgtttgttccattatttggataatatatgggtctctttctattgcctgtattttctcttgattactgatcacactgttttgactctgttatgtctaataatttttgtagtatgccaaacgttttatattaaaagaactattgaggctccaactggtatcttccatgagaaagaattcttcctttcctctgctagactaaataggatagggcctgatcacctcaatctaattctggattgagttagaccacatctggattgtgcctatggtttatgcttgttttttggacacggaccctcttgggctcttggttgggaacctaatttctagctccttagccctgaaacactgcaggagattgtcctacccttgagaggtctggggcttagttttattacctctcaccccttatagttttaaaatatctttaagaggagatcagccatgtatttggggtatactacctacttctagtggaaccttatctcctaaaaccacaagattrtaggagattttattctgccttttaaaagctctcagtctagctttgaagttycaatgtgctggcccaaaattcagcagatacccaatgagaaaaactggccacatgcaggggctccttaagtttccagtttgtcgcagcagctctcatttctctttcctccagtagagcccctcaccacatgccaagcctgatccttagtttatgccaaaattagcagatgccctcaggaaagaaaacagtatcagctacctcagaggccaccccttggaattccagttcatctaatcctcatgacagctctgtggtgtcttcctcatgacagctctgtggtgtctttttaaataattactctgactttttctagttgttgcatcgttaacattgtactaccacaactatcacttcctacctggaggcctaggaagtattatcttctacctgccctatataatagtttattaactggtctccctaattctactctcgtccctctcacaaagcagtcagagtggtccttctaagtatatcttgtccctcccctgctcaaaaccctctagtggcttccctttatatttagaataagttcagttcattttcacaggctgcagtcctacacaattttactgctackcactctctaacctaatttctctctaccctcccctttgctcactcagttacagctctactgacctcctttccaatttctcaaacacactaacatgttcctgtctcagactctttgcacttgttgttataccctctcacatcttcataaggcattgtgcctttacctctttcgggagctctgtgtaaatgtcatctcctcaaagaggacttcccttaaaattttgtttccttaccctgcattaattttaatyacagcacttagcactacctgacattatacygtatattgtgttatttttttaattttctttctctctcactaggaggtaagctccatgagagtggaagtctggtttgttcacagttctatccccagagcttagtacagtgtataacttatagtaagttctcactatttgtaggatgtcttagatatcccttacctcaaaaaattctcagtttaaggaaaaaatgaataattggagtaaaattaagaagtactgtaacatagatgtctacagaatgctttgggagtaaagagaggacactgacctagttgggacatggtcagagaagtcctcaataaggaggtggccctggatccagtgttgaaaactgagtattgatatgtgtctgacaaagagtaatagagagctcaacatataagggctactagaacatggggttggatgataggaaatgacatcagtcataatgggagagcaagatgggcagagtcaaaaaagtccttagaaatcaggttaaagaatttagaccttaccttaaaggtaataaggaataaaggtttttaagagcaaagatttttaaggagagatgctatcagatttatatttccacatgttcctctactcctcactgcaatagtcaaactaaaacttcaagtagattgatgtagaaaatccctggcatggttatcagggctcaattttaaaacaagttcttatcccaactcactatgtaacctgcggagggcattgtgtcttgttctgagcctcagaccttcattcttagcaggacagaattacaggtttctaagagccctttcaactctgagcctatgattctattaatatttatatacttcacctttgacttaggtcacaatatttgtctaaggtgccttaggaagaaaaatttaatattttttctgcatctgccagaaataatttaaaacctccaattccagccaatctaaattcagtcttcttcagagatttccttaacatttaggtcaaatgccaggaaaccagcttcttggaacaaaactacctgagcagaagtggcaagtcctttttttcttctggctgggatgagaatrcaggggggagggagggtgatagaatgagtctttttcttgcagttgtgattccaaagaatccctatcctgcctccgaygtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaaggtaggtaaaatgtgggtttcccagaaaggrataagggwttataaaggggtcattcggccaggcgccgtggctcacgcctgtaatcccagcacttaatgggaggccgaggcgggcggatcatgaggtcaggagatcgagaccatcctggctaacaygatgaaaccccatctctactaaaaatacaaaaaattaaccaggcgtggtggtgggcgcctgtagtcccagctactcgggaggctgaggcaggagaatgaygtgaacccgggaggtggagcttgcagtgagcggagatcgtgccactgcactgcagcctgggtgacagagcgagactccgtctcaaaagaaaaggcagggttgggggcggtcattcatccatacccatctctcttggaaaggggcacatctggccctcttctctatcttgtgtatcttataagaggaatttcctagaccgtcatccctacttgctacttacctgagagttggtaatattaaagatagaattggggaggataggaaacaaattttaactttgaaagtcactcatatttgaggagattctggtctagtgtacatggaagaaactgctctttgttaacctttccaaagtagatgtccagcgtgtggacagaaagcacaaattaactctgtaaatgttttttttttcttttaatcagctttttcaggttgaatgtaaatatatattttgctatctctacctcttctttaaaaaaaattgaatacctactaagtgtcagactgtattaaacaccaatacatacatatcccatgattttcacaaaaccctaagagataaayagtgttaatgttattttatagtaaattgagacttacagatgtaaaatgatttttctaagatcacatggctagtaaatggcaaaagctacagagattggcccttagatctacttccaaggtcactgcttccctagcatatattcactctttcagtctttcccacatttcctgagggacacaacacttctagtattctagtattggaaaagacagctgagtcaccttcactgagcactgttactgaaagtactacctcttagtcatggcctgtttttcatgggtatcttccctaaggaaggcattgatataaaaaaaaaaaaaaaaaaagacttctgtcagcagcttctctagggccccttttagcatcacctcctcccctcatttcttaactgttgggagatttctctgatgaatctcctgcctgaacaagaatacctgagttccagtatggagatgatacccagttctccctgggcattctatcccaatctcattaattcctccatcccaatctcattaattcctccctagggttmgtttgtttgtctgttggtttgttttgcttgtttattagcttccactgacttcagtccttgtacaatataagctcctcaaggtcaagaacctaatctttttcttctttttttttctcctgtggtaccttatatctcagtctcttgggaaatattcagaatatgcaagatgggtaggagggtaggtgggtgggtacatggatggaaggatdgatggatggatggatggatggatggatggatggatggatgattttagtgatgatgttaccaatctcagttgtctcttatttttggcttcgaattctcagtatcacctcctgatcttcctgtgtaacacgtaatactcctcttgatctgttaccactaacccagctcctaattcatttttgccttcattacccacctctcattctcatgttgtagaggagaggctgaaggccctaaggatgccaaggccagagaagccatgcttttgatgatgtgaagacatcttgaggacagtcagaagagggagaaaacttatctgggggactccaaagatagaaccagaaccaataaatggaaactcaagcagagaagctttgtctcaacataaaaggaacagttaaatctatcccaaaatggaagtaatgagcccctataactagaggtgtttcatcagggactggatgactataggagggatcttttagggagagggaattagaagtattgggtagatggttgggttaaatggcctttaagatcattcaraactcaaaaactgattctgtgattgcctctgctctgctccctcaggaagtcttgaacgtagtaaccaaagtcctttttctttccagccttcttgaaagcagtcattctcatcttttcctgtgttttatgtcctagcatttgatactcttaattctccttcrtgctcttttgcctacccctacaagtgtatatgccttccacttcacctgtgagccttatatccctttttgtttgttttgctttgatttttgaggcagggtctcactctgtaacccaggctgagtgcagtggcacaatcattgtttactgcagccttgacctcctgggctcaagcgatcctcccacctcagcctcccaagtagctgggactataggcatgtgccactatgcccarctaatttttaaaaaaaacttttgtagacatggggccttgctatgttgcccaggctggtctcaaactcctgggcccaagcaattttcccacctagacctcccatagtgctgggattacaagtgtgagccaccatggctggctttatatctctttttgaagcagagtagtcttgtggatagagcataagctttaaagtcagacaaacaggtttagatcttatctccatatgttaccacctgtgtgactttgggaaggcttctctggataaagccctgagcccattttctcacctgtaaaatggaaatgagataatgtatgaatacatataatattgtacatgtacctatctcaaataggtttacattattcaggcacctaacttaccaggcttcttcctttaggaaccctgtgaaatcctaccaccaactcattgaagttgaagtggtatttcccttcttccctgactcattcattacgtatttggattttcacttttagcagtaaaaaagcatgagcagatgttcactttcaatgtgtgttttgaatgcttcatgagagtttgcatgattgctttcacaggcaaagccatcttatatatgcctgctgtcatcagggctatctctttagagaacatactcctagaaggcagacaggttgatatggctcccagcagttatccctacatgaagcatttagtaaaagtggatttttggatctctgtgatggttatgttctccttgcattcagaaaggcttttagccagacgtggtggctcctgcctataatcccaacactttgggaggccaaggtaggaggatcgcttgagcaggagaagttcgagaccagccttggcaatataatgagacctcatctctacaaaaaatttaaaagtaagccatgtgtgctggcacacacctgtagtcccagttactcaggaggctgaggtgggaggatcgcttgagcctgggaggtggaggtcgcagtgaaccagaaccatgccactgcatgccagcctggataacagagcaagactctgtctcaaaaaaaaaggcttttaggaaactatttcttagaaaaacacctgagatctttctcccccaaaaactgccctgaacagtgtaggggaaataatagatttctctcaaatcagctttattatttcctctattattctatactgcatgcttcattaaaaaaatttatttacacttattttatgctaagtaccatgctaagaatggtacttagaaccagactttcaaagatttccaggtgaatagggatactggtatgtaaacatatcatgacaatacgttgacaaatgcaacagttcaaaaaacagaggtaacataaaagagacaatgattagagaaaaactagaaaagcttcctagataaacaaatttgtaaaataaatttaaaaagagagcatttcaagtgaaagagacatcttatattgtaaaggtgtggaccaggtaaaagtgcaagtttttaaagaagcaatagagatttagtagaataggagatttaagggaatggcaggtaatgaggtgaagagagaggcagacagagtaaagttgtttgtagagttagaagggtcatttctatttttttttgtttgtttccatttttaaagagagaaataaagtacaaagtaatgtcaaagcagacttaaactatggcatattttgcttttgtctgcccaactaataagggatctgaaacttcatatgataatattgaatctagtataaaagataataaattaagctttgaccctaaaaaagaccagaggcttgtatatagattcagaaaatgtctactaagcatctactacaggtatatgtatagctttaagccagatgctgtgtagagaacaaagataaaacactattccatccataaatatatttttgcttcatgagtgaattaagtgccaagaatagggaatgaaaagacctgtcatgggtagcaatttttttcccattcattttgacagaggaaacctcggactttgctgaacccaccacctgcctcaccaacaaccagcactcctgaaccggataccagcactgtaccccaggatgctgccaccatccccagctcagccatgcaggccccaacaggtaagagcagatgacaggactacctgcgcacaagccccagacctagtgtttgcactttcttttgtcttacaccagtaattagcacctttccacttgtaaacctaggtaaaatatttttaaaaaattttatctttggcatttgaaataatgtcagacaatcaaacttaggtaaattttctgtgaactcagggatggggaactaatgcagggatagcaccaagagctccctggcctagtttagaataatagccttccttcccagttaggggtgttccttctgagtgatcccttccaccttccagaatcctcccagcatttcagtaatggtgccacccttaaaatatgtatgaaatttctctgattttttttttttaacaatcattgatggtgacaaactttggtacaatgaaagtaaggttgacttattgcaaaatctggtggatgaaatgggtgggtaatcatcctgggttatgcatatctgttcccatttcataaactgtctatgacagtaactaaaagaactgtgcgcagatacacagccttccaagggggtaactataaagaaaaatactcattttttaatgtgtaagttaagataaatgtgtgaaaccctattctgttactcagcagacactccatcttcttctaggaagtcttaagcaattggcatgatccccatggaagttagggttgtctttctcttagaaggagttgattatgtctctaatcaaatcctagaatgtaggagcctgaagggaaggctcagacatagtttcccataaccgatagaagatgagagaacctgccatggtcaggctgtaatagtcttcattgaccattgtgtcgccatctcttgagtgggccttgattcactttgtgtgactttgatatcacttccctgtctgagcctcagtttataatctatacaatgataggattagtccaaataacctttatagtcccttcaaatgttaacaataaaagctatcacagactgaatgtgatgtgccacatttatcttttacctacttttcatttttttaactgtagagaactttttaaaaggtattttgatttgtgtcagttayacacattcatagtttaaaggaatgaagggtctacacaacttattacaaaaacaaaacaaacatacctcgtatccccctgtcaattactattccccaggggcaatcactttcaatttaactgacgtttttatttacctctgtatctaaatagcatgtctatattgctgtcttttttagttatttttctaatgactacccactctagaagatgagaatttaactcttcttaatctccttgccccttatccacccacacatatttccctaccccaactccatgatattataattttaattagatcaaaattcagtgttttgttattataactagttaaatgctgttctcaattgagccatgtagtataccgtgattacttttcctttgttgctcaacatttcattttcaggggaaatcttgttgatttccttgttttgtgtttatttttctgtgtacttattattaattcaaccttaaactctcttcctactgtgtacatctctctttatgtccaagtacattatatattctatccatgtcatactctagaagaaatctctcctggagccttcttagtttcttgagattctgttcacctctcttttttggtgagggtctctgtttgctctttccaaggtctttgttttctgtacatcattcttagatttacatatttagttttgtatgaaatctcttcattctcttggaaatttctcttaattcccagtaccctaaaatttcactttggatatattttcacctaccatactggacacttttattttataaaatttttaaaaatgagctgagcatggtggctcacrcctgtaatcccagcactttaggaggccaagacggacggattacttgaggccaggaattcaagaccagcctgatcaacatggcaaaaccccttctctaccaaaaatacaaaaattagccaggcatggtggcacatgcctgtagtcccagctactcaggaggctgtggcatgagaactgcttgagccgaggaggtggagtttgcagtgagccaagatcgtaccagtgcactccagcctaggtgatagtgtgagactctctctcaaaagaaaaaaaaattctttaatcaattattttctttcacttctttttctctattcactcccgtcatacctgtttattcagtttttgaatctcttgacctggttctgtaatagtcgtayctctgttcttacccctattctttgccttttggtcaactttcatcaagttttcctcaactatatcttccaaactttgtattgagtttttcatttttgccatcttgctttttaaattataattatttagtactccagtggcattttccaaagtctgtttggtagaaacaccagacctgcaaaatgctctccataaaaggattttacacacgtttaggaaatttagttatatacatttaggaaatgcttatactctacttccccgtggttggagatttgcatcttgtttatcaagagctctttttgttgttctttgaaattttttaatagacttttattttttagagcagttttagattcacagcaaaattgagtggtagatacagagatttcctatatacttgctgcccctacacatacattgtctcccattcatcaacatcctccaccagagtggtacatttcttagaattgatgaatttacattgactcgttattatcacccatgtccatagtttgcatttgggtttactcttggtgttttacgttctgtgggttttgacaaatgtataatgacatatatccaccatcatgtataatacaaaatagtttcactgccctaaaaaccctctggtctctgcctattcatcctccctccccactaatccctggcaaccactgatctgtttattgtctccatagatttgtcttttccagaatgtcacatagttgaaatcatacagtatgccaccttttcagattggcttctttcacttagtattatgcatttaaatttattccatgtattttcatgtcttgatagctctttttttttttttttttttgttgttgttgttgttgttgagatggagtcttgctctgtcgcccaggctgaagtgcagtggcgcgatctcagctcactgcaaccttcacctcccaggttcacgccattctcctgcctcagccwtccgagtacctgggaccacaggcgcccgccaccacacccgactaattttttgtatttttagtagagatggggtttcaccatgtcagccaggatggtctcgatctcctcacctcgtgatccacccgcttcagcctcccaaagtgctgggattgtaggtgtgaaccaccacgcctggccgatagctcatttttttttagcactgaaaaatatttcattgtccagatgtttcacagtttatttatccactcacctacttatgggaatgttggttgcttcaaagtttttgcaattgtgaataaagctgctgtaaatatctgtgtgcaggtttttatgtggacatacggtttcaactcctttggataaataccaaggaagacaactgctagattaaatagtaagagtatgttttgttttgcaagaaaccaaaggggtttcaagatggctgactagggctgggcacagtggctcatgcctgtaatcccagcactttgggaggctgaggcaggtgtatcacttgagctcaggagttcaagaccagcctgggcaacatcatgagacccctatctctactaaaaatacaaaaaaaatagccagctgggcacgctgatgtgcacctgtggtcccagctactcgggaggctgaggtgggaggatcacttgattccagggatggggcagggcagaggttgcagtgagccaaaatcacaccactgcactccagtctgcgtgacagagctagaccctgtctccaaaacaacaacaacaaaaaaagatggctgactaraagcatttcatatgctcacctcctccacttagaaaaaccaaaagagtatatagacaatcatacttctgataaattatctaagatagaacactggaattcaacaggaaagtgacaggaaacacagaaagcaaggaaggagaaagaagagaagcagcctacctggctgagattggctaggaaacagcaagtgacttcccaagggtaagcaagagacttctagcagcccacatccccacgtatggaatcatgcattcctggcaacgagagccctttaccttcccaacccctgaaactgacatagggagctgccagaagaccaggagagggaactattccaggggaggagcttgcactgggtcacacaccctttctgagccataagcagctacagttgacgcaccattttcaatcctagccattggcagactgcattctgtcctggggcctagcagcgccaggaatgaggtgttagggaaaattgagctgttactgcttggactagggcaaaaattggaaatgggttcccataggtaggactcacaagtgaggcgtaggctgcacctgccagttctttgaagctagtaccaccaggactgaaactgggatgtgaacagggtgcaaggttctgctggggcttatctaaaatgtcattgccaaacccaaggtcatctagattttctcctatgtgatcgtctaggagttttatagtttgcattttacatttaggtctattatccttttggggttactttttttcaagagtgtaggttctgtgtctaggttcacttttttacatgtgaatgttcagttgtttgagaaccatttgttgaaaagactctctattttttattgtattgcctttactcctttgtcaaagataagctgattatatttatgtgggtttatttctgggctctctattctgttccattgatctgtctatactttaggcaataccacactgtcttaattatggtagctttacaataagtcttgaagtcaggtagtatcagccctcctggcttcgttctgggtcttttgcctcttcatataaagtttagattcagtttggtttgctattgttgtggaaacagaagtgcactctgttgcccaggctgaagtgcagtggcacagttacagctcactgcagcctcaatcttcctgggcttaagctatcctcccacctcagcctccagagtagctgggactacaggcacatgccactatacctagctaattttgtagagacggggtctcactatgttgcccaggtctcaaactcctgggctcatgcagtcttcccaccttgatctcccaaagtgctgggattacaggtgtgagccaccacccccagctgrttcaatttgttgctgtctacaaaataaattctgggattttgattaggattgcagtcaatctctacattgacttggaaagaactgacatcctgacaaaattaagtcttcttatccatgaacacaaaatatctgtttacttagttctttttacgtttctttcaaaaaacttttctagttttcctcatataaatgttatatatattttgtttaacttatacccaggtatttcattttctggtgctaacataaatggtattgtgagggtttggtttgttttattttttgaaatagggtcttgctgtgttgcccaggctggagtgcagtggtgtgatcacagctctccgcagcctcaaactcctgggcagaagcgatcttcctgcctcaactgggtagctagaactacagacatgccaccatgcctggctaatttttttatttttattttttttatagagatggtttctcgccatgttgcccaggctggtcttgaattcctggcctcaaacaatcctcctgcttcagcctcacaaagcattgggattacagggagccattgtgcctggcctgtatggtgttttttaattttaaatttcacttgttcattgctgctatataggaaagtgattgactttttgtatattagctttgtatcctgcattcttgtaatcacttattaattccaggatgtttttggttgttaattatttcatattctctgcatagacgatcatgtcacctgaggacaaagttttatttcgtccttcccaaactgcattctttttatcttactttttgtcttactgcattagctaggacttccagtatgatgttgaagaggagtggtaagagagggcatccttgtcttgttcctgattttggttggaaagcctctagtttctcaccattaagtatgatgttagctctaggttttttgtagatgttatttattaagttgagaaaatttccctctatttctagtttccaatagtttttattatgaatgagtgttggatattgtcacatcctttttctgcatctatcgatatgattatctgatttttcttacttagcctgttgatatgatagattatattaattgatttttgaatgttgagtcagccttgcatactttggataaatctgacttggtcatagtgtataattcttttttatattgttcaatttgatttgataatactttgttgaggacaatgctggcttgataaaataagttagaaaatattccttctgcttctattaataacttctaaaatagattttgaagaattggtataatttcttccttaaatgttggtagaattcacgaatgaacctatctaagcctggtactttccttttttgaaggtttgggtttaattaattcaattttttaatagatataaacctattcagattgtctattcttgtttgagttttggcagactgtctttgaaggaatgagttcatttcatctaggttatcaaatttgtggacatagagttgttcatagtattcctttatctgtttaatgacaataggatctgtagtgatgtcccctttatcatttctgatttagtaatttgtgtcatccttctggttgtttgttttgtttttttgtttgtttgtttgtttagttagcctggctagaatataattgattttatttatcttttcaacaaaccagcttttggtttcattgttttttttattattattattttttagacagagtctcgctctgtcacccaggctggagtgcagtggtgcgatctcagctcactgcaacttccacctcccaggttcaagtgattctcctgcctcagcctcctaagtagctgggactacagacatgcaccaccacgcccagctaattttttatatttttagttgagatgcggtttcactgtgttrgccagggtggtctcgacctcctgccctcatgatccgcccgcctcagcctcccaaagtgctgggattacaggcgtgagccaccaygcctggcctgtttcctctattgatttcctgtttttgatttcattgatttctgctctataatctttaygattttttattttctgcttactttggatttaatttgctcttctttttctagtttcctaagatggaagctcagattgctgcttttagatcttcttttctaatatctgcattcagtgctataagtcaccctttaaacactgcttctgctctatcccacaaattgtgataagttttattttcattttcatttagttccaattttttttttttttttttgagatggagtctcacactgtcacccaggctggagtgcaatggtgcgatctcagctcactgcaacctccacctcccaccttcaagcaattctcctgcctcagcttcccaagcagctgggattacaggcacacrccaccacacctggctaattttttctttttcttttttttttttttttctgagatggagtctctctctgtcccccaggctggagtgcagtggcccgatctcagctcactgcaacctccgtctcctgggttcaagcaattctccttcctcagcctcctgagtagctaggattacaggcatgcgccaccatgcccagctaatttttgtatttttagtaggatggggtttcaccatgttggccaggctggtctcgaattcctgacctcatgatctgcccacctcagcctcccaaagtgctgggattacaggtgtgagccaaggcacccagcctaatttttttatatttttagtagagacagggttttaacatgttggtcaggctggattcgaactccttacctcaagtgatccacccacctcggcctcccaaagtgctaggattacaggcgtgagccaccatgcttggccatttccaaatattttttaaatttctcttgttatttcttctttgacctatgtgttatttagaagtgcattgttgaatctctggtgatttttttcatgtatcattctgttgtgttctgaaagaagacattgtgtgattattcttttaaaatttgttcaggctgggtgcggtggctcacgcctgtaatcccagcactttgggagtctgaggccagtggatcacttgagctcaggagtttgagaccagcttgggcaacatggtgaaaccctgtctctaccaaaaattcaaacaattagccgggtgtggtggcatgcacctgtggtcctagctactcaagaggctaaagtgtgaggatcacttgaacctgggagacagaagttgcagtgagccaagatcacaacactgtactccaacctgtgtgaaagagtgagaccctgtctcaaaaaaaaatgagaaattttaaaaattaaaaaaatatattcagatgtgttttatggtccagaatgtgatctaccttgctgaatgttctacatgagcttcaaaagagtatgtatcctgctgttgttggatgaagtcgtcaatagatgccaactatatttcagttgattgaggggctattgagttcaattatgtccttactgattttatatctgtttgatgtgtccatttctgatggggggtgttgaagtctccaactataatagtggatttatctgtttctccttgcaggtctgcctgtttttgcctcatatatctgacactctgttgttaggtatacacacattaaggaatgatatgtcttcttggagaattggcctcttattatgtaatgcccctgtctttccctgataattttccttgctctgaactctactctgtctgaagttaatatagctactccagctttcttttgattagtgttagcatggtatatctttctttactcatttacttttaatctatatatgtctttatatttaaagtaggtttctggtagacaacataaacttgggtcttggttttttaaaaatttttaaaaataatcatttacatttacaccttagcagaattcaagctcctctcatcctcctaacctggtgatctttcattagctttacaaagacagtttagttttggggaagggctattatcgtttaaactataaactaaatgtctcccaaagttagcttgtcccaagcccaggaatgattaagggcagtttggaggttaaagataagataggagttgattagatcagatctctttcactgtcatattttctcactattacaatttttgcaaaggtggtttcagatgaattaagattaaggaaaataggccaggcatggtggctaacatctttaatctcactactttgggaggccgagttgggaggattgatcacttgagcttaggagtcgccaacaacatagcaagaccttggcaacaaggtcttggcacctaggcaacaatgtagcaagacttctctactaaaaataaaaattaaaaaattaatcaagcatggtggtgcatgcctgtagccccaagctactcaggaggctgaggcagraggatcacttgagcctgggagattgaggctgcagtgagttacgayagyaccactgcactctaacctaggtgacagagtgagaccctgtctcaaaaaaagaaagaaatttaaaaaaaggtcataattaattttgtctttacttttttcttctctgatgctcttcctttctttatatagatcgaagtttctgatctatatcattttccatctttctaaagaacctcttttaatgtttcttgcaaggcaggtgttctggcaacacactccctcaatttttctttttttttttttctccctcacatttcaagaacagttttgcagggtacagaactttaggtcggtgggtttttttctctcaacactttaaatatttcactctcttcttgcttgcatggtttcttatgagacattagatataattcttgtctttgcccctctataggtaagacaattttttcctctgttctgtttcagtgttttttctttatctttgattttttgtagtttgaaaatgatatgcctaggtgtagatgtcggggtttttggcatttttccttcctggtattctctgagcttcctgaatctgggatttggtatgtaacattaatttggggaaaattctcagtcattattgcttcaattcctttctctttttcttttccttctagtatcaccattatatatagattacatctgttatagttatcccacagttcttgaatattctgttatggtttttttttttcagtcttttttttctttgcttttaattttgggagtttctttcccttgagatatatttgtaaaggaaaattagaaattctctggacccgccaaattccttatgaaatgggagagttccttgacctccctcgaaggacatgcaataggggtgtggcttgtcttttcagcgccgtgcactcaaaccccttacaggagggggaacacgtagatgggcaagtgcaggagctaggataagcacttttggggcaccggccccacagtagcatctaagggtgggtgtctgtaactcctgaagccccagtgggcatgctacagtgctcttttagctctgccatctacagatggcttaagtgtaaaccagctcagtgccctcttggtacccaggttcttgtctggcatccaggaagaatcaggtcacacacagacttgaagaatggtgaatgtggagggttttattgagtggtggaggtggctctcagtgggatggatggggagctggaaaggggatggagtgggaagatgatcttcctggagtttggctgaccagcagctgatctcctctctgaccatccccagccaaactcctctcagtgttcagatgctccttctcttccctccttctctgctgtgccattctgccactcttctgctcatcgatcctggggtttggggtttatatgggtacaggataagggggcatggcaggccaaaaggcaacatttgggcacgaaaacaggaatgcctgttcccatttagtgctgtgggtttccaggcttgggggtggggcctttgccagggaattgccctcttctacccagtatttccctgtctcctgtctgtatcacttatgcaacagggaagggtaaacctgggggttaagccatgtaacaccatcttccaggtgaatagctgttactagcattacgcattagccagatccccaaaggaaaggtaaaaagcctcaggcatccatgaaggactgcctgcacagatcattcacaagtaaactcttygatggtctcccacaagcaaggacacaccagctgcaacttcaggtctataatctaagtctagctcttaaactccacactgataatgtcaatatcatatcttctcaggtgcagaacaaagacaaaggggactrgtcattcctccaccaacccagagatgtctgcataattgatttttactttaccccatttttgctcttcaaacattcacattatcttatgtaaaatgtagatttgccaagcacttactaaagtctcacaagaatgtaaccattccccttaccgcctacctgccctcctttaagaaaatgtataaataaggccgagcatggtggctcacacctgtaatcccagcactttggaaggctgaggcgggtggatcacaaggtcaggagatcaagaccatcctggctaacacggtgaaaccccgtctctactaaatatacaaagaattagccaggtgtggtggcatgcacctgtagtcccagcaactcaggaggctgaagcaggagaattgcttgaacccaggaggcggaggttgcagtgagccgaaattgtgccactgcactccagcctgggtgatagagcgagactgtctcaaaaaaaaaaaaaaaaaaaaaacaagaaagaaaatgtataaatactaaaatcctgaaagcctctttggaacagtcacagatgtgtctgtggctcatattttccccagacatactccaaagctagcttaataaaccttgattgattgagaccatttcttcagtcactcattcagttatcatgctcaaatgcagcaattcttgccttagcatgtctaacctaataatgggccaatgaaaggcattcatttcattttttttctttttctttttttttttttttttgagacaatctccctctgtctctcaggctggagtgcagtgtgcagtcacagctcactgcagcctcagcttcccacactcaggtgatcctcccacctcagcctcctgtgtagctgggactacaggcgcacgccaccacacctggctaattttttgtaattttagtagagacaaggttttgccatgttgcccaggctgatattgaactcttgagctcactcaatccactggccttgaccccccacaaagtgctaggtgtgagccactgtacccagcccattctttatttctgttacactatttttgatctctggtgtttcttttttattttttcttggaatttccatctctctgcttacactgcccatctgttcttgcacgctgtctagtttattcattagagcccccagcatgttaatcatagttgttttaaattcccagtctgataattccagcatccctgccatatctgagtgtgccgctttttcttcaaactgtgttttttgtccttgagtataccttttttgtgtgataactggacatgatgtactgggtaaaaggaaccatggtagggccaggcgcagtggctcacgcctgtgatcccagtactttgggaggtcaaggtgggcagatcacttgaggtcaggagtttgaggccagcctggcaacatggcaaaaccttgtctctactaaaaatacaaaaaaaaagaaaaattagccaggcatggtggtggaggctgaggcaggagaatcgcttgaacccgggaggcggaggttgcagggagccgagatcatgccactgcactccggcctgggcgacagagcaagattctgtctcaaaaaacaaacaaacaaacaaaaaaacaacaacaaaaaaaacatggtaaataggtctttagtgatgtggagcgatgggaagcattctacagtcctatgactaaatctcagtctttcaatgagcctttgcccctgggctgtgaacttaacaagtgcttctggtccccgcccccacctctttgggttggatagaatggcctggagtgcggtatttctcttctcccgaatggaaggctagcattggctggagttggttatttctcctcttccagatcagttaggctctgaaaaatccctaatagtttaggctgtggtaaaatagtttctcctgagggaagaccttgttgagaacagagggctctagtatatttcaaaatggttccttttcccctctccctgccaaaagcatgagggtatttttctcttatatttactgtgagaatccgrttgagctcctggaggcaaaactcacaaaagtttccccctcctccccagtgactgggactccctggagttttaatctcaaacttcttcacactgagcctctgacaagtcatcaagtacagtttaggttttcctkccctagcactagttccagagacttcggcttattcacctgtctgtctcttcaaatttgagggctaatagtttgccctgagaccttacttctctgacagatgtaaggattgttgacttttcagcttattcagctttttactggttgttaggatggagtggcaacttccaaactccttatgtgccagacctttctctgaatttttttaataacctccaattctaatttaatggatctagtaaaaaaaaaaaaatgacagtatacacaaatatccttatgacctcaagattgggaaggatttttaaaataagacaataagcataaactataaaggaaaagatcaatatattctatattaaaatgaatacagctcatctctgcgccacatggcatcagttggggtacctcaattggggcttatgataattccattcacataactagcagaactcatgttgyctgttggttctcgccaaaggataacttgggctttgccataccatggtggctgcgttcctagagcaagtttctcaagagataggaagtgaaagctaccattttcttaaggcctgagcctcaaacttagcatagcatcattgccaccatattctattgatcaatcagtcacagagcctagattcaagaggagaggagtagaccccacctctcaataggaagagggtcaaataatatgggccatattttaaaactacctctctattctctggacatggattattaacattttttccacttgcaaaatttattcttgccctcacaagatgccccatcagaagtctcatccttttacaccagtaggctcaaggtctaggatctcatcatctaaatcaggtcccagtacacgaggcctcttaggtgtggtttgtcaaggatacctccttcaatgtggttcttcttgtcccgacgacctgtgaactaaagaaataagttgtctgctcactacctacctaacacacagtggtgcaacagacacgaggtaacatttatagatgctttcttttcaaaagggaggaaacctgaaggcatgcagcagtcactggtctatagaaattctgaggccgggcgcggtggctcacgcctgtaatcgcagcactttgggaggccaaggcaggcggatcacaaggtcctggctaacacagtgaaaccctatctctactaaaaatacaaaaaattagccgggcatggtggtgggtgcctgtagtcccagctactcaggaggctgaggcaggagaatggcgtgaacccaggaggcagagcttgcagtgagctgagattgcaccactgcactccagcctgggcgacagagtgagactccatctcaaaaaaaaagaaattccgaaatccagctgggcacatgttggccaactccttaattaggtccagtattactttctgggagttgttttccatggatcttggttttatcctctgaatcatccttgttttccataagaaaactgagattgcctttttagtttccttcctgcctatataaggttgggcatccaaaggattttttccattttgtaccatctttcttgcttttagtccaagctgtcaatgcttctgccagaatgattctcttagaaacgtgagaggtttttcagctaggtgcagtggctcgcccccataatgccagcactttgggaggccaaggtgggaggattccttgagcccatgtgttcaagaccagcctgggcaacatagtgagaacccgtctctacaacaaagtaaaaattagttgggcatgatgatgcacacctgtggtaccagctactcaggaggctgaggtgggaggactggttgagccctggaggccgaggtggcagtgagctatgatcatgcatgccactgcactccagcctggatgacagagcaagaccctgtctgtaatttaaaaccaaagaaatttgaggggctttctttgaactgtcagagttcacttcattagacaaaagccacaactacaagtcttttaatgataagcccttctctactttgggcttcctattcagctgctgtaggacagtactcttaagattcttaaaaatcctgttgtttaaggcaaagaatctgtgaggcttgcccttaagattcttagagaaccttttaggcctgagagtctgcacagcatagagttacatctttcttacatcttaaagaattttactgtccttttctagagtcgaaatcctttcataatttatagttttttgccttatggagagactggaaataagaaattttatttgtaaattctgcaagtcctgggggtatgtggaggggtgtgtgtacatgtttttaagctcatctcttgtcttgcattttatcataagcagggagaagccaggtgatactttcattactttgtctggaaatctccttagctatttccttgagttcatcaggaatatttcttatttccatgttactataggcaacagtcctgtcaaactttcaacacttcccctttcatcgatcttccaataagattttcttcactttcccttaaaccttcactgacagcctcattaagaacctttaggccgggcgcggtggrtcacacctgtaatcccagcactttgggaggccgaggcaggcggatcatgaggtcaggagatcgagaccatcctggctaacacggtgaaaccccgtctctactaaaaatacaaaaaattagccaggtgtggtggcgggcgcctgtagtcccagctactcgagaggctgaggcaggagaatggcgtgaacccgggaggcggagcttgcagtgagccgagatcacgccaatgcactccagcctgggcgacagagcaagactctgtctcaaaaacaaaaaaaaacaaaacaaaaaaaaaacctttaggcttccattaaaactctcctcgagtctccttcagttttcactgacactctgtgtggtcctttatgcttctttctgctccccaggtccagagccaatgccatgtgtgtcagccttttgttactgcagcaccctatttctggtatcagaatctgtcccaataatcttttgccatgtaacaaccaccacaaaatttcatggtttaaaacaacaatgtgggcaggcctgggtggagacagcttgtctctgttgcatgcagcgtcagctggggtggcttgactaggactgaaggatccactttcaccacatggccaaccagctcgttctggctgttggtttaaatggacctccctgcagggtggctttgcttcctcacacatggtagttggggtctcaaagcaaatgtcccaagaaacaggaagtggaagttgtcagtttcttaatccttaggcccagaaactggtacagtgttgtttctgcatagtctaaaggctttatagttctgccttttatatttcatcatttaatccatgtagatttttttaaatcatcaccagactagttatattatttcctttttgtgtattttaactgaggtaaagtttctacctttagtgaaatgtacagatcttaagcatacaatttggccgggcacagtggctcacacctgtaatcccaccactttgggaggctgaggcgggcagatcacaaggtcgggagttcgagaccagcctgaccaacatggtgaaaccccatctctactaaaaatacaaaaattagcctcgcgtgatggcacgtgcctgtaatcccagctactcaggaggctgaggcaggagaatcacttaaatccgggaggtggaggttgcagtgagccaagaccgcaccactgcactccagcctgagcgacagagagagactctgtctcaagaaaaaaaaaaaaaaaagcctacaatttaatgagttttaagcacccatgtgactacaactccaaggaagatggaagacatttctgccacccccgaagttcccttatgcctccttacagttggtctccacttccacctttatgctgatttttatcaccatagattagatttccctattcttgaacttactataaatgaatcatactatatgtactcttttgtatctggtttatttcactcagtgttttaaaaagcacccatgttcttgtgcctatcaggagttccttcttttttactgccaagtgatactccattaaatgaatatacactcacgtattacttaatcacggggatatgatcagagaaatgcatcattagccagtatcctcattttgkgaataccatagtacatcgatcttcaacctttttggcaccaaggactggttttatggaagacaggtgttccatggaccagtggcatgggggatggtttcaggatgaaactgttccatctcagatcatcagccattaattagattctcataaggagcacacaacctagatccsttgcatgcgcagtttacaataggattcatgctcctgtgaggatttaatgccactgttgatctgacaggaggcggagctcaagtagtaatgctcactcgcctgctgctcaactcctgctgtgcagcccctttcctaacaggctgtagacccccgtattggtcttcagcctgggggttggggacccctgtcatagcgtacttactcaaacctagatggtatagcccattgctcctaggctacaaacctgtatagcatgttactgtgctataggcagttgcagcacaatggttaagtatttgtgtatctaaacatgtataaagataaaaaggatacagtaaaattatggtttaaaagattttttaaatggtacacctatacagggtacttaccgtgaatggagcttgcaatactggaagttgctctgagtgagtggtgaatgagtggtgagtgaatgtgaaggcctaggatattactgtacactactgtggactttataaacactgtacactttggctacactaaatttttttttaattttcttcaataataaattaaccttagcgtactgtaacttttttacattataaactttttaactttttgactcttttaataacacttggcttaaaatacaaacatactttatagctgtacaaaaatattttatttttatctttattctgtaagctttttttatttaaaaaacttctagatttattttatttttttactttttaaacttttttattaaaacccaagacatacacacacattagcctaggcctacacaagatcaggatcatcaatgtcactgtttcctatctccatatcttgtcccactggaaggtcttcagggacaataacatgcatggagctgtcatcccgtgataacaatgctttctcctggaatacctcctgaaggacctgcctgaggctgttttacacttaacttttttaataagtaggagtacactctacaataatgataagaagtatactaaatacacaaatcagtaacatagtcatttattatgttaccaagtattatgtactctacgtaatcctatatgctatattattttatatgcctggcagtgtagtaggtttgtttacaccagcttcctcacaaacacatgagtaatgcattgtgctatgactttacattggctacaaggtcactaggtgataggaatttttcagctcccatgggaacactgtcatatatgcagtctgccattgaccaaaatgtcattatgtggcatatgactgtaccacaatttgtatctcttctctttttggtggatatttgggttgcttctagtttggggttattatgaataaactattatgaacattcttataggtgtcttttcatagacacttgtttttattactcttcttatctctctggattcctgcatttttagttatttcagtaaaagagtcacattactagatgtgaaaatcctgtttcttaaaagacttcagttaaaccttcttttattagatccccctcacactcacctccagaggcaccaactctgccgattattaggccttttgcaaattatgagagcgtggttctcatcactccccactccagctttagggtatacagctttgttgggtctgttgagtcagtcgctacgtttccagtccgctttccaccttcctaatcttattgtcatctcctctcttattatctggctcattttagtgagtttttggagagaacagagttaaatgtattcgttcaattcatcttgtttacccttttcttctttttgtttttatgtttctcctgtcactttccacatatcacctccctactttctgttttccatttcttccgtccatgttggttctccttagaattagaattatgaaggtggagaatcctcagagagcatctggctcagtcacttcatttttcaggtggtgaacctgagacccaaggagaacaacagtccatccacgggccacacaattactgctcttatcttttctacctttaatagcaaagagacttttgcccttctaccccttcagctagtgagccacaaccacacaagaaagaatagtacccgctactcaaatgggaagctggaaagcagatggaggagaaaatgtcattgctgaccaggttgctgtgggtcctgaggagagaacaactccagagacaactctgttaggactgcctcggtctcctgtgcccactgcaccccttccccactgcagtgccaggtggaggccagtagctaggagagtgcttagccgtcttgggaccctcaagctcttttcactttttttttttttaaagacggagtctctgtcatccaggctggagtgcagtggcgcgattacagctcactgcagccttgaactcctgggctcaagcagttctcccacctcagcctcccaagtagctgggaacacaggcacatgccaccacacctagcaaattttctgtagagatrtggtctcactgtattgcccaggctggtctcaaactcctggctttaagtgatccttccgcctcagcctcacaaagtgctgtgattacagatgtgagccactgcacccaattttttttttttttttttgagaccaattctcactctgtcccccaggctggcgtgcagtggcgcaatctcggctcactgcaagctccaccttccaggttcaagcgattctcctgcctcagcctcccgagtagctgggattacaggcgcccaccaccatgcccggctattttttttttttaatagagacggggtttcacctcttcaccaggctgatctcgaactcctgacctcgtgatccacctgcctcagcctcccaaagtgctgggattacaggcgtgagccaccacgcccagcccaacttttttttttttaatccaattttttttaaaatttttattatattctttgggcatgagtgttgatgtagaagataacaaagggaccctaaggcccaaaacagaaagcaaggcaaatgatcaatggtgcaactattctaaatccaatgacatacatacacacacacacacacacacacacatatgcccttgctaatattgccattgccccacagygccttacacatatatggtaagaggtacaaagaatatgtgaggcaaccaagtacaaaaaaatggaagtacgtacaagaggggaattgtctagattttcttttcagtgcacagaagacaaagtgcaaactctgtgtcttggcctttggtctgggccactcttccagtcttcccacagaytttgatcatgcagtttgggttggcagtagctgggcacagccttttcttgaccctccaccctctacctcccacagcatttcaccagctcagctgctaggaattctgttaggaaccagaggccaaggtataaaagatggaataggatgctgttctctgacttctctatcccagagactcttgaagcttctttgattctttgtctcccatagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcaggtaagcacactttggctcatattgcctcccagccagaaggacccaccttctcaactggttgatttcttgtaaggcatcctggttcccacttcatacctgcaggctctggaaaaatgtgaaggtattccattcctcatctccaaccccccaagagcccctctgagccttatgcatacctctgccaaggagaatacccacagattctgcttcastgagcctctaaactgattccccccatctacctgattgacctgtccgtacagaaagtataggagaaagaatccagagggggctatgttgtggcagcaggagggtttctccagactgttgcagcctcccacctggtttcaggaaccactgaactcctctatcattcctttgattccttagcttcctcgtcctaaaccaggcccagaagaagagaattaaatcccagggtggttgggaaaagtcatttcctttttctttactgctatgagagtttgattcagtgacacagtgttttttgctctcacagaatactcattttttctcctgtgtcctgattctgtttcagttttcctaaatccaaaatcctgtttagccactaaacctatgaagacttgacctagagcctttcagtcttaactgatgctattccatattcccctgcccctcctccctagcaggttgtaataaccagcttcaggaaaccccgctggcatggaagactccataaataaccagactgtattattttagcaaacatttattgaacccttactatgtgtcaggtgattgccagacactggtcaggagaaggggagaatagaagatgacagcttaggctccataccagtgaaaaagaaagaatatacatagctaactgtgagaagtgctgtaatagggaaatgtatacagagtggtgtgggaacccagactagggagtacttggctgtgaggaggatggagcagacaggcagggaatttttatagaagactaggaattggccaggtgcggtggctcacacctgtaatcccagcactttgggaggctgaggtgggcggatcacctgaggtcaggagttgaagaccagcctggccaacatggcaaaaccctgtctctactaaaaaaaaatacaaaacattagccaggcatggtggtgcacgcctgtagtcccagatactcgggaggctgaggcaagagaattgcttgaacctgggaggcggaggttgcagtgagctgagatcgtgccattgcaccccagcctgggtgacagagcaagactccgtctcaaaaaaaaaaaaaaaaaaaaaagactgggaagtgcctgggaaattaagccttatgtcccttctgaggcccagcctactccctggtctcttctttgtttctgtgtaryggtctgtaggaacctggccttctttactgcctctctttagctgctctcctataccctctctggggttcttctcctgcctcaaaactggttcttgagaatgacctatctccccaaatccccatgtccttgctgccctcagagacaaatacacaggtctttgctttttaaggtttatactgatacatttttatagaaaaagatgataggaagtaaactaacaccaagcatgaaacagttccaaatgttgccaaaattctagtgcccttatgtagatcagaaattgtgtacccataccattgctggctatggctatatwctactcttctgccaagcttctctgttcttgggcagttcttgtgaaaatagcaccctaaatgagcagatttcctgggggaggtccaaccaagtgatggagcagagagaattatgttcacagttgttttcacaagttgaataaaatcattccagagcccagggtgcaacagacctggcctggccactcccatatttgcaagccctttacagttggaggcaaaaatcaaagccctcgagggagggagttaaagggagggagggaggaaacgtggggcactgattccctttgtgtaaccaggtaagcctgagacaagcagtgggctggactcgtcctgcctagcgctgtactccactgccaggctgacatgcttggccctgtttactcactccacagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtaggagctgggatggggcctgggctgagagtgggggacagggctagcagcagcacctgcaggggcccagggtcagccttcagaactactggcctggcacctactatctagaggtctgcttttctgtcccttacctttgccatatctgagacttctcagcctcctctcatctttactttttcttcaggattttgttttctgtctctaggatcacccctatttcttctagatccttatccctagataaaaggtggttcgcaattccccttctgagtttcagactgcatgtggagccaccaagaagtcacagaacgtctcccagtktgaacctggcagcaaaggcctaacacacatctcccttgccagcaggaaggtttagtctcaggctacagattgagaaatttgctccctggtgattggccatctattctttcctttggcacatggccctaacttccagcactgccagtctagcaagtcaattcaagttcctgctatttctaactcggctggaaaataactttcttagttaacataccagacccacaatgggaaagcagatgccacgtggccaaatcagtgactaagtacttccgagagagattaaagattcaatggaactctgcgtctctcatctggaacccaggacacagaacaagggagggaagaaaagctcagccttaaacatagcaaggtaggtcattactgagagggaggaaaggcccttaaaaaagccctgcagattgtgtcctgagcagagaaatagggaggggtgctgccagtgtgagtgctgtgctgtctgttgatgggagggcacaggtctgaaaggtgtcttttccgaccttcctctacacaaacaagtcttgttcccacactgccttccctggtgtcttttcatcatagtcttaacagaatcacctccgataaaagcactgcttctagagaatgtgcccagggaagtgactgttcccccattctccttccccctttccctcatagatacttctgtacccaaatccgtattgyttatgtgacttgcaagcaggtcaaaaagatacctgaattttaaatactctgtgggggccagaccatctgatccctgcagccatttctrtgatcccctggctgatccttttctatggagggaacttctcctcacctaacccatgctagattgctttctttcagtaccagagtctctgagaaaagaaaaaggcattctgacttgcagttagaatgttgcactgggagtctggactgggcatggtagagctggtccagacaaaggcaagttttaaatacctccagttaggcattcaggaactctgatctacatttcagacgtgaaagttaggcctacctgggattctraaagaatggatgcatgaatgggggttagcacatccatgaatgtagctgctagtttaaaaagagatttctcaaagaaataggaactccgaattcttaaatggaatgccatcattaagaagtgagagaaacatactggtagcagcattcagagactggtaaggatgtacctcatgggcctgcagtcccaaaagtggtttgggaccggggcatgacctttcctgggaattctgccccaatttacatctctctgattcagccactagataagaggaagcaaactttagccagactcttcttgcctcaccaactaagagaaacaaagaccaaggtatcacattctgccattagctgctacctctcccttccccrttttcagacagattgagcccactttttgtgtcctcctctgctcttaagctgtttctcatcgtgggtgctcagcaacttgtctgctctcactctagtttctatttgcttccctgaaattagcctttaactatgcccagacaagccagagccttgcctaaacttctaattcctctgtgcttcttagtgtatcctttctgcctgcttgcctgcctgccttcctgcctgcttgcctgccttactgaccctttgccccacctctgatattatcatttcctgtgtttttctgattacttacctaaacctctgccaaagagctcgatctgtacaagagctgtcttttgctttgccctttggatctggtatttatgactcctgcccttctgcctggctacacgcttctgctagacatacataggtaccacctctgttatctgggtgcttactggccctccccctttcctatatccttgtctccacactaccctaccacttagagtcctggcccaactgaccatgcacttccgatatagcaggtagtcacccaaagctcagggagatttcatatcccattaagctttcctacctaagttgagactactacttttttctccaatgttttattttaaaaatttcaaacctacagaaaagttacaaaaatagaacartaagcaaccatgaactctttgcctatctttaccactttttgcagtatttacttcgtctgtttctcctaactatatatacacatataaatatacatacttgttgaatacctgtatatttaaaatgtttttcatttatttactgaaccatttgagagttaactgcagatgagagattttatccttaaatacttttgtgtttatctcctaagaataaggaacataatagtattattatgattaagaaatttaacataaataaaaactaatgaggccaggcgcggtggctcacacctgtaatcccagcactttgagagcctgaggcgggtggatcgtgagatcaggagatcaagactatcctggctaacatggtgaaaccccatctctactaaaaatacaaaaaaaaaaaaaaaaattagccgggcgtggtggcaggcacctgtagtcccagctactcaggaggctgaggcaggagaatggcgtgaactcgggaggcggagcttgcagtgagcagcgattgcgccactgcactccagcctgggcgacagagcgagactctgtctcaaaaaaaaaaaaaactaatgaaatttaacattaataaaatactactaggccaggtgcrgtggctcatgcctgtaatcccggcactgtgtgatgccaaggtgggcagatcacttgaggtcaggagttcaagaccagctgggccaacatggtgaaatcctatctgtaccaaaaatacaaaaattagctgggcatggtggtgtgcacctataattccagctactcgggaggctgaggcaggagaattgcttgaacccaggaggcagaggttgcagtgagccaagattgtgccactgcactccagcctgagcaacagagtgagactccgtctgaaaaataataataataaattaattaatatactattagctattatgtagttcatattagaatttcccctagttgtcacactaatgtcctttatagctgttgtttcctaatccrggattcaataaaggatcatccactgcatttaattctcctgtctctttagtttcctttatctagaacagttatccacctttttttttctatctttcaygacgtgacattggcattttgaataatccaggccagttgttttactttaggtcatcaaatatttacaaatacttactctgtgcccrattctatactagactctagggagacagaggtgagacagactccatccctgtgctcaaagagctgagacaggtagagatatgtgaacatgtatgtggtgaaagcagagcacagaggtactctggcccagcaaagcatgatgagcaaggagtatggtaaaagaagaagtcaagggaggattcctgggggaggcaatgtcagagcagagtctcttcttcagaactatgcatgtggctggatcaaataagaggctggtgaaaactaaaagaggcccagccaggcacagtggctcatgcctgtaatcccagcactttgggaggccaaaagtggatcacctgaggtcgggagttygagaccagcctggctaacatggtgaaaccctgtctctactaataatacaaaaattagctgggcgtggtggtgcatgcttgtaatcccagctacttgggaggctgaggcaggagaatcgcttgaacctgggaggcggaggttgcagtgagctgagatcgcaccattgcactccagcctggatgacagagcgaaactccatctcaaaaaaaaaaagccccttctggcaccctaaaaaatactgagaatggtgacaaagatattgtccctaccttcagtattagggacaatatgaacatgtatgtggtgaaagcagagcacagaggtactctggcccagcaaggcatgatgagccaggagtatggtgaaagaagaggtcaagggaggattcctgggggaggtgatgtcagagcagaactatacatgtggctagatcaagtaagtggcttgtgaagactaagtaaaagaggcccggccgggtgcagtggctcagtatgaggcaggagattgttaggacagtattaagcaggagattgtattgatttcactggtcccagtgactattaagtttagctgtaattgaaatctacccagcattaaactctgagtctgctgttttgggattctcaggttcctctctgttagaggaagtggttcattgcccatgacactggttccttgtgcctttctttccagttgtcatcctggtcttctgagttagttataaagtggttctcctgccaaaatcccaagattcacagtggttaaagccaaataaaaactgaaatatcaggatgtgctctgattcccacataggtttccagcctagaattgtcagagttttaagatgacgcaaatgctcataattcactgaagcacactgtctggcacacgtccgcttttcaggtggaccttcgtgggaccacagcttaaacttcaaggtgtcaggaagacctccaaggctctcctcatccaaaagagatgcacctgatactgtccatcttaatatcctgtttctttcctttgttataattataatagttgctaatatttttagctacctgtattttgtcatctgcctcactatagtaaatgttccatgaggatagagacaatatctttttcaccattctcagtatccatcatcctaactgtcatatggtaagtaattaatagtatttgttgaatgaaagagcagtaaacgatgtgggaagtggttcagagagggattttttttttttaaacactgagagtgatgtaaacatgcacaaggactatgctatgtctttgggtcctgcgttggtgtaagaattttcttagatcaacatctctagttccttggtcactcagttcacacccataaaggggaaagctcggttatgagcatggaatctttgtatcttggaagtggaaagtactctagagataatctagtatctagcccaacacatgagggtggtcatctgacctctgcttaaatattcctgatgacaggttctctctatctttggcaattgattttattgttgggcagttctgattgctaaaatgccctcctttttttgttgttgttttgtttttgttttttgttttctgttttttgttttgagacagactttcactctcgttgcccaggctggagtgcaatggcacgatctcagctcactgcaacctccacctcccgggttcaagcgattctcctacctcagcctcccgagtagctgggattacaggcatgcaccaccacgcccggctaattttgtatttttagtagagacggggtttctccatgttggtcaggctgatctcgaactctcaacctcaggtgatccacccacctcggcctcccaaagtgctgggattacaggcatgagccaccatgcccagccaaaatgccctccttttaaagctgaaatctgccttcttacaactcctgcccccattctactctctgtattccaaaagagcaaatctacctccaatcttcttcttttcccatgactgcccttagggtgtttctctcccttgacttttctccggacgatgccttcccgttgcctttcccctttgccatgatcttgaggttcctcaccaccactctgatcatcctccactgggaactctaatttttaaggtcagctttgcaatgtgatactctgagaagagctgcttctcactgaaaatacatgcataagggctaggtccttatctatttgtttacctctgcatgtaccataactagtatagtggctgtcacacacacaaagggtgctcaacaaatgtttgtttgatcccagttgctcccatatctgcagcatatcaatagtatattttacattgaccctaggaagtttaagcatttttcctctccattttatagatgggcaaaggaatcctgtaaaaaggcagtgatcattgactaatcaagtcttccagccccagtctttgacacctgcaccagtgatttcaaagtttgttttgttttaccagtagaactcctttttttaaaaaaaaaaaaaaagttttttggcaaaggtaaaattatatataaaatttgtatacactccagtgcataaaaattaaaaccagagtagttttgatagaagcttggatgaggcccataaccctatttacttggcctccctgtggaggttccacagggctctgtagaacacagtttgaaagtattgcagtcttcaggccaggtgtggttgctcacacctgtgatcccaacactttgggagaccgaggtgggcagatcacttgaagccaggagttcaagactagcctggccaacatggcaaaatcccatctctgctaaaaatacaaaaaaaaaaaatcagtggggcatgatggcatgcactacttgggaggctgaggcacaagaattgcttgaacccaggaggtggaggttgcagaggagtgcagtgagttgtgccactgtattccagcctgggtgatagagtgagactctgtctcaaaaaaaaaaaaaagtatttgcaatcttcttttctggcactgtcctaccaaagagagcctcgtctgatcagccttgtcaggactaggaccccccagagctttggagcatgatgctttcagtacatctcattaggataagatttyatgacttgccatcagtccagattttcagacccttcaactcagaatctacgtctcagtgttcttagcattgctgaaaggaagagacactcaatggtttgcatcagcatctggtaagcctctggctttgtcatcataattattcttcacatctgttagctcatgtgaggcagacaatactatmcccagtcttagctgaataaaatgagaactagaagagtgaggttaccctgctgataaatgctgaaactggatgaaatatttttcttgtactatcacagacagcttagatttgccacttcaactccgaatgaaatacaaaataacaatttttcacattcataaagttcctcccattccattttctcatttgatgttctcagcatgataggggatgatttttccccattttacacatgaagaaactggtgcttagagaagacaagctacttgtctagaatcacatacctagtgaaaggcaggagcccaggtatagaacccaggtctcctatatcctggattggattcccattcatgtctcaaaatgggaccctgttagtcatttttcctggaaaataggagtcagaaccctcatctgcagaaggaggtgggatatggcttaggtattatggaccctcrgacttatcttttcagaaccacttctaggaaagggtttcaacaattagcctccttgatataaaggtaaatagctgtctaatcctagattttactttgagctcatagttgccaagcaattttaggtaagtattagaaagcagtcctaaaatcctaaaccatcttaacattgaggccttactgtgtgccaaacaatgtgctcaaatttagtgttcatcagaggctccgaatgaatcccaagcattacctaaacacttgatgtctttgaaaaatgataaaggacagtgttatgctccagtactcaagacaccctccacaagcagagaagctgtggcctaggctgaggaactgatttggtttgggtagaacccagtcatgaggaatctgcttcgggttctttgtacagtgattgggtgctgccgcctggtgttgggccatggactgggtatagaaacatcacggtaagattccctttacaaggaaagactttcatagccattcttttgtgatattcacaaactccttggaagaaaggggcttcccatgttgtagatgaggagactaacattctccgagaagcactctgctgagtggcagagccagattatacccgattctcatctccatgcccaagctcaccgctcatcaaccccagcttccttgaagtgtttctgtagaatagggcaaatacaaaatgagagatggaacataggagcagattctttacaaacaagcctttaaccaagcatcaagaagcatttctgacatgtccagatggttgagcagagggtcaccttttaaagtaccttcatctaagcaatgtgtcccagctctagcatgttgtgtctaaggcagtatcttccatcctagaatagctccatttgtttaagatgttccttatcaagaaaaagcatagggcatctagaccagaaaaagcctcaaagaccatctagtctaagagaaagaatttctaaagagaccaaagtccagagagtggcactgagcttgactaaggtcacctcatgacagccacaaccatgactggtacacaggcctcctgagtccctgcccagggctttctctgttgttgctgcttgctccactcaaacaggtatctgggagccagcactctggcagtccttctaagctctaactctggttttactgtttttcargtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggtaagcttaccagagtcctggccctccttccctccctcactctttccttcacttccttcctgagctctgggaggccagagaggacctagctctgttgccctctgcctggtggtgggactagggactggacttactcttgtgcctggccttgcacctgggaggtaattggagctccaggattggcttgagcataacagaaactaagagccaaagacctagacccaaaagggacagggaaggattcattcactcattcatccattaactatttatttgaactccatttgtgtttggcatggggaagcaaaaatcagtcactttttatcttcaaggtattatggtgagagagacacktaaacagataattattaaacaatgtcttgagtgcagtgacagacatatgctttgggtaatatgaaaattacaagaaggaatacctaacccaagcttggtgttcaagggacactttcttaagggaatgatgccttgcctgagactgtataaatggccatatcagggctggtagaggagggagagctttccaggaagaggggcaacatgaataagggcaaaagaataagaaatagcactgattataccaggaactgcatgcaatttggaattgctcaaccataaaatgtaatactgagactcaaagagaaaagcctggaaaggtcaaggcatatatcatagaagaccttaaatgggcgtttaattagaggcaagacaggtttttgttttgaatagattattgactactgtgttgagcatggatttgaggagggacaaaactagagaaacctaaacaagttaggaggttactcgagtgggccagatctgaagtgacaaaggcctgggttagggcagagacagaaggtttggagaagagagagtggatttgaaaactgttcacaaggcaaatttaatcagatttgaggatttaatcagatgtgaggaagaagggagtgaggactgtctcccaggtttctagatgtggccagatagatggtggtgccatccactgagagagggaacccaccatagaagagaaggaaggtgggggagcccatggtcatatagatgacatctaacaggcagtggctatgcagatccaatcctcagggaagagtgctgggctgaagttaaatatttaggagtcaccagtgtataaacagcagttgaaattttagggtgaatgatactcacttctcagaagtatgtagtgaatgaaaataacagttaaccaaagatgaagtcctgggaaccaacaaagcttaggaggtgagaacgggaaggtgagcccaccaaggagaaaaaggaatattcaaagtgagggaaaatttagaaaattcaaagtgagaagaatttgatattgtggtggccaggactacagagagtatttgaaggagagcacagcataacaaagttctggcaaaaaagggactgagaaacatctattggattccaccattagtgggtaattggtggatcttagcgaaagcagccttggtgctgtggtggaggggtgaaggcagattgtgctggggactttgatgagaaaaaaaaggctggtgatgagtaggactctaagtcaaagaagatctttcagaatgggagcccttcaagcacgtatgtcagcagacagcttgcaccttccaaaaagtagcaattaagaatataggaaagaggagaaagttaggcttcaggagtggtgggatcaagggcataggcagaggcatcagtcttaagccaaaaggaggcacactttctctgagagaggagggaagattgagtgtgtccatcagtgaatagagaaaggcctggtcagggaaggggttaggagcgctgatagactggactagtcttaaagaagatggggaaaaatggaccaaagaaaaggggatgatttgcaggaaacctmagggcccaactatgcttggagactagttggccagtttgcacaagctatggttttcttctgtgattcttagcaacctagtaggtatgggatgagaaaagacagcttgagaattaagggcttttttgctgagctagtagagcaagagctgggaggaagggggagagtatgtaaagaaatcaggaatcaggaagagcagtttaagtcatcaaccactacatctgggaaggcagtcagggtaggaaggatgcaaggctaaatcaggatagggaaaatggaaagtttgacatgccaaagaactttgtgatataatggttacagtggacatacgtcccaagagagctgaaaagatggaaggttggggtcagagaatgkgatgcttaaaattctgaagtggatttattccaagggattgcaagaatcagacagtggtgttggcagtaggtatttggagtagaatggaggtgagagtcactggaggcatggtagctggattgcctccaaggattagagcaggagttggggtggaacagtgggwagtgagctaagtaacaaaaagtcttcatttaycaaggggcagaaacccagatatctatgagtaacagtgagaaggaagagccaatggttgggtacatgtttggcctctgaagaacatgagctttcataggaggatggtctagaagcagcagtggggagccaggagaatgtcacttccacaccctgattccagcctcctccagcccagggacgcatgagtgaggtgtgaaagtataggaagactccattagcagagcctgcaatgaaaaaaagtcacctcggccgggcacggtggcttatgcctgtaatcccagcactttgggaggccgaggagggtggatcacgaggtcaagagatcaagactatcctgrtcaacatggtgaaaccctgtctctattgaaaatacaaaaaattagccggacgtggtagtgggcacctgtagtcccagctactcaggaggctgagacaggagaatggtgtgaacccaggaggccgagcttgcagtgagccgagatcacgccactgcactccagcctgggggacagagtgagactccgtctcaaaaaaaaaaaaagaaaagaaaagaaaaaaagtcayctcagcggrgagagctttcaggaaggctgaatcatgggaagaagcctgtggtgcccctccccccaccccaacccgagcagggcagcaaaatggaatctaaagggctctcaagtagagaggcagagctgagcgctgattctagcctcggctcccttgctttgagacttgagtcagtcatctcacctctcaggtcttcctcatatgcagaatgttcctcatgtgcaaactggagatggtgacaccaacctggtctttccacaggagtgttaaaaggatcaaatgaaagaagggatatggaatcattttggaaactaaatcgttccccaggtatgaggggagttactgttatttttatcttccccaaggccctgtttctgagaagagtactttgtgataggctgccctcctggcactggcctcagatggtactgttgttccctaagcatctccaattttccttggaaacccaccatgagtctgtctgccaggtcattgtataaatctctttacagcctgatggtcttcataaggctatgaaaagattcattcggctggccctagaattatttgtcttaaagaatttggatgttgagtctgtttcctctcttactgcattaaccaggatgattaggcatgagcttgttagttggcctcttgtggatgtgcctcaactgccttagtcatgctcagactgagacaacaagccctccttgaagagtaagtgccagccgtacacattgaggggcgatggggagagctttgccataggctgtctgcagagggaataggaaaagacagggcaagtcacttcctctctcttttcacccctcccctctgaactaaagatggtgataacgcctccttcaagggctattttaaaggtcaaatgagttgacaatggtgggggttctttatagaatattgttgatatatcaggtcacctttttaccactgccaccctggtagttcatgccacagtggtctcttgcctggcttatcataatggcctcctttttttttttttaatagtgtctctcactgtgtcacccaggctggagtacagtggctcaatcatggctcattgcaacctcagcctcctgggctcaagcgatcttcctctcaagctaccttccaagtagttgggactgcaggcatgcaccaccacacctagctaattttttgcagagacagagtttcaccatgttgcccaggctggtctcaaattcctgggctcaagcagtctgcctgcctcagcctcccagagtgctgggattataggcatgagccactgtgcctggcctaatagcctctgtctttttttttttttttttgagacagagtctcactctgtcgcccaggctggaatgcagtggcgcaatctcggctcactgcaacctccgcctcttgggttcaagcaattctcctgcctcagcctcccgagtagctgggattacaggtgcctgccactacgccctgctaattttttgtatttttagtagagacggggtttcaccatgttggccaggctggccttgaactcctgacctcgtgatttgcccacctcggcctcccaaagtgctgcgattacaggcatgatccaccatgcctggccagtagcctccttcttaactggtctctccatgtccccctgaagtctgttaccaacatagacaatgagagtgatccttcttattgcaagttggttcatgtaactcctgtgctcaaaacctacctatttcactcagaaaagccagtggttttccatggtgtacagggtcctctgttatcttcactgccacttccctcctcttcctcaacacacacatccatgcctcttagtgttatttcacaccactttctccctcattcactttgttctgatacattggccttcctgctaaatcctacatgtgctatttgctcttctgcctcaaggtctttgctcaaatttcatcatttcrgagacatctctcctaatcaccatataaattagcaacttcctaccacctgccctcatggagtttatattctaatgggagtaggctgacagacaagcatataaatatatagtagtattaaatatgtgggtcgtcttagtccatttgggctgctctaacaaagtaccatgaactgggtggcttataaacagtaatttatttctcacagtcctgaagactgggaagtccaagatcaaggcaccagcagatttggtgtctgatgaggacccacttcctggttcatagacagccatcttctcactgtaacctcgcacagccaaaggggcaagggagctctctgcaccgtgtttgatgagagtactaatctcattcatgagggctctgcccagaggtccyacctcctaatatatattatcatgtgggtagggaggggtaggatttcaacatgggaatgttgaggggatacatattcagtcagtagcatgtgtgtatttatatatactatcatatatatgtgtgtataatatcatgtatgtatgtatatatggtatctagcctctgattagaggaattatctaagrtggtccaagaaagacacattcttgcatatacactctctccccatatcttctctctgttctccagagcctctctgcacttggtttctctcttagcatcacagtagacttttaagacagggagaagtgactggctcacagagccccctccaactttccatctgttaacacctccaaaaagccactgggatttctgtgactctaagcagcccctgctggctctagcatacctctccccagtgcccaactataagcttgaaaagacaatatgctagaatctctgctccaaaaggggctggactaggccaggccagacaaagtgtactttgactttttaggcccgggacccagaatgaaggcaaatgggaggagattcttagcctttgccggagagagttaaatattaggcccttttactttaacaggtgtgtgtgtgtggtggcggtgggggaggggggtggttgtttgtttattgtttgtttttgagacaggatcttactctgtcacccaggctggagtgcagtggtatgatcatagctcactgttaaccttgaattcctggactaaagccatcctcacacctcagcttcctgagtagctgggactattggtgcataccaccacacccagctgatttttttacttgttttgtagagacagggtctcgcaatgttgcccaggctggtctcaaactcccggcctcaagcgatcctcctgccttggccacccaaagtgctgggattacagcgtgagccactgcactcagtgtacaggtgtgtgttagctctgccacttgatagtttgcaacaaggcacctctggatgctgtagatacagacgtgagcaaggcaaggaccctgcctcaatagagacatagtctggttggagagaaagaaaaatatacaagtaactattatctgtgatcattatttatctaacagatgtgttcgaacatctactgtggcagaccaggcactcttttatgtgtcagcaacatagcaaggaacaagagagagcttatattgtatagggaggagacagataagaaacataaaataaatgagtccatgaaattattttaggtaacgatatgtactgtgtgggggtagggggaaactagggtaattggattgtagagaactgtgcggggaattgagcatttttactaggagatcagggaaggcctctctgtggaatcaatatttgaggtaagaaccaaatgttgagaaggagtcaggcatgaaaagatttgggaaaagaacattccagacccaggaaattgcatgtcagaggataaatgcttgacttattcaagaagcagaaagaaggctagtgtgtttgaagcacggcgagtaaggggtaagttgcgggcaggggttgcagagtgaaatgaggccgaaggtaggaaggctcagctgatggagtacctcatagatgctggcaagcacaggaaggagttcagatttcatttcatatgcaaagggaggccactgcattgagtttttagaaggggttgacatggttcaattactgctctttttgtttttgtttttgttttttttgagacagggtctcgctctgtcacccaggctggactgcaatggcgctcacagctcactgcagcctggaactcctgggatcaaatgatctcctgcctcagccttctgagtagctaggactgcaagcatgtgccaccataccagctaatttttaaaaattttttgtagagatggggttcttgctttgttgcccaagctggtcttgaactcctgggctcaagcaatcctcccatgtcagcatcccaaagtgctgggattataggcatgagccatgatgcccatcctaattattgctttttaaaggttcctttactgcttcatggagaatagagattactagcatggtgtgatgggggaaaatggtacagaatgatctgtaaccaagaatatactaaatactttgtgagaccatttatttcagtatttgaccagaaaagtttcataaaggaactgatccttgaagccgagacctgcttagttaagttgaagtttgcccaaagaaaattaaaaattgaagggagagaaggggacagattccaagcagagagaataaaacatgtaaaagatctctgacagatgatagtcaaaatacagagatcccaaatcccacaggggaaacaggaggcgttatatctgagtcaaaattgagatgaaagctccaagcaaaacactaaattaacattgagattcctggcagccaaagcaaaaacttttgtggctgggcgcggtggttcacgcctgtaatcccagcactttgggaggccacggcaggcagatcacttgaggtcaggaattcaagaccagccaggccaacatggtgaaaccccgtctctactaataatacaaaaattactgcatgcctgtaatcccaactactcaggaggctgaggcaggacaattgcttgaacctgggaggcagaagttgcagtgagctgagatggcgccactgcactccagcccctgggtgacagagcgagactccatctcaaagaaaccaaaaaaccagcttctgccttagtgtatcaggctgtaatgaggtcacctattctccaggccttggaaaagaatccagggtattttttgcccacgtgccaaggatttgtctctaatcttaccaggctaccagtctctctagaaatggtcccccagagccaaggcaaaaacagccccactcaccaggccccccagacacccaaatagtccccttaccatgttggtaccactgtctcaggtttgggctgaatcatagcctcaatgcaaaatttcttctggccatttccaaaaatcagatctacccttaaaaaacaaagatttggctttccctttgtgaagaaatgcttccctcccccagctatctccagttcctcagctcatcgtctggcactactgtgagcatcacctagaaggccactgagatgtgccaaggagagtggtggggatttacaaaccagtccccgccctttatggtaggtgccctcctgtcctgcagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgtaggtgctgctgcctgacctctcagtaggaacmtgtgtggagagcctcacctggtggggacaatacgagatgtttggggaggagggatgcttakagacaaaggctgaggagaacaggtaggcttcagcatcacagcaggtgaactggactccatgtggcgggcacttcccaggatggcctataatcagaacctggggtggtcagaccaaccaggactctgatggtgcctcccttccacttctgcccacctccccaccccccaggagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctargaatgaggggcatcagcccaccccaggcacctcagtggggttccgggccacctcaggactcyaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggctyatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataccagtgtctttttaatcagttaacagccaaatcactacgcattcattggaccagtcattccccttctcttggtcttagttttctcatacataaaacgaggccgagcacgctggctcatgcctgtaatcccagcactttgggacgccaaggtgggaggatctcttgagctcaggagtttgagaccagcctgggcaacatggtgaaaccccagctctacaaaaaaaaaatacaaaaattagcctgctgtggtggcgcacacctgtagtcccagctgcttggggagctgaggtgaggggatggcttgagcctaggagatcgaggctgcagtgagccgtgttcgcaccactgtactccagcctaggtgacaatttgagaccctgtctcaaataaataaaatggagagcttggaaaaaatgattcctaagcgtccttctaattccagcagtccctaaagaacaggtggtcttccgaatgtccaccagagccccagcatcacacaggccccttggaaagtcagtatgtgaatccagtctccaccctcaaagggctttgctctggtgcagctagacagtagtaagcacagcagctatgcaaagccagagcaggagggagcaatcttacatcagcaactcctaggagcctcagtggctgggcatatcctcacccatatagggtggggaaagatgcaggccagcacagccaggtcaggcctgcactgtaccccttgtgctgaccaggggccaggcacacaactccagggccacacgtcgtgtttataattggagtatagggtttgcaggaggaagagaaggcataggggagcagcaggtcagtgcagtataacctgataataaccaccaccaacacttatatcactgtgtgccacatgagctgcttacatgaattagaactatctcacttactcttcacaacaaacccattttatggataaggaaacttaagctcaggtcacacaggcaggaagtgccaaagcagacatttgactgcaaggctgaggttctagccagcccacctatgtgccaggaagctttgggtgggtcatttcctttctttgggcccatctggctatggggtatttgcatgaggagacttgtgaaggcccttcaagctttcaccagtgacaagttccaatatcataacttacttagaatatattttctacttggccactgtgaggttctaaccatggtcactgtgaaacagtcagggtcaaggctgccaaacaagttgaggccctcattttctaccaactccttgacactggggttttttttttttttttgacagtgtctctgtcgcccaggctggagtgcagtggcacgatctcggctccctgcaacctccgcctcccgagttcaagtgattctcatgcctcagcctcccaagtagctgcgactacaggcacacgccaccatgcctggctaattttttgtagttttagtagagtttcaccatcttggccaggctggtctcgaactcctgacctcaagtgatccgcctgccttggcctcgcaaagtgctgggattacaggcctgagccaccgcacccggccaacactgggatcttgtagactgtgctgttcattcagggtattcccaatgagcaccttgctgaaccctaacaacaaacttctagatgtgaccctcaagacacagggactaaaggtgacactggcatatgtaggcaggccagacatgctgcaaagctgggcacccaccccaccttaccctcttcgccaagagtatgtaacttcctactgagcattgttgtgagaactcattgtgctgagttgtttttctacactatcccactgaaacctcacaacagtcctatagtataactactgtttccctatcttacaggtgcttagagaggttaattccatagctgttaaggggtacatgtcctgctgcctgcaactctctcccgtgggcctttgtctcagatccagctaccattcagactccagacccctgcaggctacactgggcatgtcattaactttgaagactgtcaaacagaaatggcctggctgcagggcagcgggaagcagccctcttcaggggaggagggcagtcctcacagagcctctggtcatcaggagttattctccttggttgcccaggtgacagctcaggtacaagggaatgagacacatcagggagaagggggttggttcactgtggcttagaggcatcattccccaaaggagctcatatctctttgaacaactcaataggcatagctttcagggaccccataagccacatacccaattgagtcattccacataggacgcccaaccttatggctttttaacaagtgtttatagttcacacagaaaactccaagtgctgataatttacaattaggaatcatgcttaccataagtaatgttgcactgaaacagctaacatacttttatctggtttccagacaaaaagaactagaaaggtaaccaaatgtcaagttctgcaggaaaggagaggatgattcacgctgccataacctctggggtcaaaattaaatgttgtttaagaaagaaaaaaacccctcaactttggaaattgtttcaaaagccaaaagccttctaatagtgacccagaatcattaaaagcactcgaacgggcctcagacccagtgcacacatgctgcagtgttggagaggccactccgtgaaccccagcagtccagtagcccaccaggtggaaaggcacaggtgccagaggtctcatggcatcagcttcatgtgctcaccctcaatggggggacagggagatgacactgactttgtgctgagctcaggagggaaacaccaaacactttgggaggtaacagagatctaggccccacctaaggccgaatccatgggagtgtggggcatttttctggaacactccgccctccccagccgtggctccaccctgcctgctggccgtggactgcattgtccagacactctttgtgggggtcttatgggactccttaagattgatccctgaggtgtagcaatggtgggccaaatggacactgttccggccctcacactggtgccacactccctcgttggcaagagcctgaaggtgaatcatccctccttctttaccaccaaaacaaaaagtgtgggaaaccttgagaagagggtcccaacacttctcccctcagcagccctcagctttttgcagcctctttacctaagtaccctgagtcactggacatggtcttgccaccacattccgtcagggcagagccacagcttccagccttcagcccagaggcagtcacagccaagcatcagaactgcggctctgtgcctacagtgccaaagccactgcaggtgctcacagaggctggcagcccacagtacccagggcacagacactaggctggagccactcaagtcagagatactctgcagtaactggggctgggccctgtcagagccaggtggggatctacaggctggaggcagcacgctaggggagggcttgagaccaagggaggctggagtgatgtgggtcccaggacctggaaagctatgtttgtaactctgctccccagagttcgctcttcttgatcatccttgttctctcctgcacctggctgggctcattcctcttccctatccctctgccccttgactggccttcctgggcaaacagcagattgtgaagtgggagctgtggggaagaggggatggcatgcctgctgtgggttcagggattgtggccatgtgggccacccagtggacactgtccagataacatgaaaagaggccatccacagcggctcagctctctgcccctcatctttgggccccacctcacattcataaagaggcttaaattctagggttttttccttcagttcaagatgaggtttgtcagtgaggtcacagacatccagcaagagggttaacggggctgcttatccccccactgggaacccaccactccaagctgcctgcagagcacctatactttctaatactattacctaatactagagagccagagacaccgtaaataaccttgttatcttatatttatgtatttaaaagatggttcataaatgtgtttagtgcttaccatgaaagacaatttttacccccatctccaaaaagaagtagaactgattcagctcacagaaggctgttaaaggcgccagagaaatatgtgatgcagtggcttaaagagactgccaggaagagtggggaaagttgctgcactcaagtcaatttgggaaatttcatgcagaacagccacccaatagcaaggcctctaggtaagtagggagaacgcctctggtcatgttcaggtgtttcgtctgtcaaggtgcttctcccggacagctatttctgcacagttcaacacgacttgagttggccatctcaaaacagctatagcctcagttgctgtgagggcacctcatggatgacagaggcaagaaaggcttgagggagagggggtgaggcagggggagcttggagccgtcattctctaaccctaagagctgtggacacaaagccgagcccaacctggctgctgcccgggcgggcaaggagagggcaccgaatgcactctccccagagcctcgcactgccaccagttgaggcctgcgcccctctcttccccgcacaccatagcctcttttcttgagtgctctacccaaactactgcctcaccccctaggaaacaaacatttggtaacatcttcagaaaggctgctttcaaggaaggcagcttctctacgctgtcaaacagctttcttagttgaagcatctaactgtggcaccatccttactgcccccaattggggcttccagaagcagtgtgggcaagcgctgccagccttctgcagaatgatgagcactggtcagtcctgtgctgataaagactgtgtgtcacccacgtcttggtttctccaacagcaggtaacaacctcatcttcccaaagagatagatagctacgcctgacctatttttcagggctcttctggacagcagcctctgtctccagcacagagaagggcctggcgtcagggggagccctggagcctaccatgtgcctcctgctccatcttgggagcagctgggccctgtcagtactcagtagagcctgggattggtgactgactaaagagggaggtggaggctttaggcagcagcgctgaaagaggtggcaagaggtgacctgcatgggaactggggcctgaagagacatcactaagtggggaagtgtgtcccacagccaagctgcatggtgggtgggccgctgggtctgcttccagtgtgtggtgggacccacagggagctgagttttcctgtttgatttcccgcacccagcctgcctgtggctggccaagaaggcattgttgaacctcatgagatcacagaggtagctgtgcaggccccgcccacttcctataaccctggttctggccgtccctgtgccaagcctccaagttccctgagagctaccggccaggggtcgggaggctatgggagctcagggcaggcacctcccatgctcccgcgggagccaccaggacatgaaggtcataggcctctcctctcctcctcttcctgtttgacctgaatgcccccaggccaactgcctcaaggattccatttgagaagatgcaggctgggtgtgtggggagcagtagaggggctggtgtgtgcacatatgtgcacagctcaggacagaggctccctggacttggggcgggggcactagggccccaactctaaccctcgttctgccctgttgacctctgctctctggaccaaaaatggaggactcagtctagactagttcttagggtctaggagccaccttaagttatgtttatatgcaaaggccatttttctgagaggccatagctttcatcagtgtgccaaaaagcgtgagatcctctgctctaaaagcctctgccccagcgctgcctagtttcagagcccccgatggcctcacatg

SEQ ID NO: 12475 - DNA, 21361 bp, Homo sapiens
gtctcgaactcctcgcctcaagtgatctacccgactcaggctcccaaagtgctgggattacaggcatgagccacagcgcccagctaatttatccatttttagctgttgcatagcatcccactgtacgaacatgtatcaacgcatttattcattctactcttaacatttgagttgtttccagttttctgttgtgtgtgtgtatgttagtacgtgtgtgtgttgttaatatgaacaatgcttctgtgaatattcttgtacatgtctatcgttcaatatttacaagagtttctctgaagtgtacacctaggaattgtttgctgagtgatggctatatgaatgttcagccttctaagataatctcaaactattttacaaagtgattgtacctacttatacagctaacatgaatggactggaattcccctcggccaccttgctatcgtccaactttttaaatttttccgattggcagatgtggaatgggccattcagctttcctcttctctgcaaatctattcatattttgcccactttctcactgggatgcttttctttttcttattgatttgtaggaattttccatattctggaaactaatttcttgtcagttacatgacttctaaatatctgctccctgtttgaggcttttttcattataattatggtatattttaatgaataaaaattgctaaatcagtatcaattttgtacttcacagttttcactttttgtgtcttgtttaaaaatactcctttactctaattcctagagatattattctgtgttttcttctaaatgttgtatagtttttaacttttcacatttttatctttaatgaatctggaattcattttcttatattttaggtaaattttgccttagacagaaatacaactgccatttgttaaatatgggatactccatttctttcctcattgatttgaaatgcccaagccgtacaaaattagtttctataggcaacagatctgtttctgagctctttgtgctaattcactggcttatttccagatcattgtaagagccatcatgtgaaaggcaaaaccataaaattagaaaacataatatgcattcttttttttcttcaacttttattttaagttcaggggtaaatgtgcaggatgtgcagttttgttacataggtaaacatgtgccacggtggtttactgcacagatcatcccaacacccaggtattaagcctagcgtccattagctattcttcctgatgctttccccccaaccacaggtgccagtgtgtgttgttctccgccatgtgtccctgtgtggaaaatataatatgcattcttaacctgtcaatatctaaagttaatctgtatgtttgctgttttcctaaacagtcccgcaatttagaacaatttaactccattcatccccttccagccctcatctactttaattccatattgttttttcttctcaatagatatattattttatagccaatacttgtctttacatttacatttggtcgcatgcttagcactctatttgttcattattttaattcttttatgcatctcagaactttcatctggaatcatcttccttctgcttaaaacacattctttcagattgctcttagtgaaaacttagaagttgatggcaaattcagttttttaaatgttgaaaatggctttattttacccttcttcaaatataatgttaccgagtcagaaaattccggaatggcagttatttcctcccagcacattgaagattctattccatttccagtgtccattgttgcttttgaggagtcagtcatcagtctaaccaccattcctttgttggtgatttattctctatctgcttgtaattatctggttttctgcctcaatgtgtgtagtgatttatttttattccttttgcctggaattcattaggtctccttaatctgagaacttgggttttttttaaagaattctataaaattctcactttttattttgttgaatgttttcttattctcttgtgtcttcttctggaactctgattagacatatttagaccttctaattatagccttcatgccttcttgacttcctccttcgtcacttagctgcattctggaaattttcctcagagctacattttgttcaataatcctggcttaatctgttcctggatccatccactgaacttgtaattttaacggcattatttatttcctctggtttgtatttcagatctgcttggtacttgctccaattttaagtttgttttattttctaaaacaatttatatttatattcttcatccaatcattctatagccactatgagacaataaataaatccatccaactcatcaaaacacagctgagaattaccaaataagtacaaacaaaaacctaaatatgactgattaactgtgcagaatacaatgatgtaagtttactatacatcaacctccttgtacccatctcctcgcttcaacaaataactcagggcaaaacttccttcatccatacttccaccctccttctccctgtctgaacaagatgccactccagagactgcaggttctatgtctatcatatgtgattgcaatagcttggtcatggtagaatacaaaaaaaaagaaaaaagttgaaagccctctgaaaactgtagtgcttataatagccttcccaactactggccatacttaatattaatcattaacactctcagtagagtgtctcagaagtcaaaatgtatctcctactagctacaaggaagttgggatctaataagtatttatttacagctgcagtcacccaacagcctgaaataccagggtctctaaattcatgactttgtgtatgaacaagggtcaataggatctttactcagtcctcgagatataactcagaaaaatgaattgctgtgaaaaactcacttgatttcctgtggtcacattataagatcgaataatctacaaaagtacaaaactcagtgatatagagaagccagcaaattctcctgcccttatataaacaggtgggaggctttccagtagaattttttctactccaacaaattggtagattgaatgactatacctcataatgatgacactattgtatcatattttagtttaaatttaaaacctcaaaaacttaccaaaactagccaaagatttctggaataagatatagacaaagttatttctcaaaaaaaagaaaaaaattggctgggccgggtgcagtggctcacgcctgtaatgccagcactttgggaggctgaggcaggcagatcacaaggtcaagggatcaagatcaggctggccaacgtggtgaaaccccatctctactaaaaatacaaaaatcagctcggcgtggtggtgcccacctgtaatcccagctactagggaggctgaggcaggagaattgtgtgaaccggggagggggaggttgcagtgagctgagatcatgccactgcactccagcctggtgacagagcaagactccgtctcaaaaaaaaaaaaaaaaaaaaaaaaaaacggctggacacaggggctcacacctgtaatcccatcattttgggagggtggggtgggaggatcacttgagctcaggagtttgagtccagcctgggcaacatagtgggaccctgtttctaccaaaaataaataaataaaaattatgtaagcatggcgtgtgtgcctgtagtcccagctacttgagaggctgaagcaggaggatcacttgagcctgggaggtcaaggctgcagtgagctgtgattgtgtcactgcactccagcctgggtcacacagtgagaccctgtctcaaaataaaaataaaatggaaaataactaaaaatgggattttcaactctttgatataaataggtccagccataaggaagaattgtgctacaaaagagaacaaaaatcatcatgtttaacaactgcattcatgttcttttctaattataaagctaactattgattttataatgcttctacacaccttgatcatgtgttagcatatgaaactcttagctgagaccaacttactataaaacttgtgtaatttaaatagtataattttccaatgactttaatctaacaacctcctaccccattaatcaacaccaaaaacaattcatctttgaatacatgtataaagaacatagttcatgtgtttataaaaagttcttctctgctacagagtttagctgtgacatctattaacaaagtaatttataactctaataagttagcaaggtcttcttgctaccagtccagtcattggtggtgagtactcagtattggctgatgaatacatgaatggataaaaatataagagctgcccacacatataccataaaatgcataaaatagattccattttatctcaatttttatttctgtgatataactaagataaaatcaaacacaatgtattattttaaagtatactgtttataagagagaaataatatgatctgaccttattttagaagaaagttgtgtgtaaaagaaatttaaactcaaaagtaaaaaagccactggtttctaaaaactcaaaaaaaattttttttaagtgactggctttcagaacaacagcaacaacaaataagccactaaaataagacaattaaattccaattttttttgcatttacttgcttgcttaattatatacaaatctcaattccattaaagtatcaggatgacaattaattagatgtttttagtgacttttccaatcccttctaattaacttggaagtgattaactgattatctaattatattaattagtgattatctaattaactaaggaagtgatttacatgcttcatgggaagtgtgaattctcagccagggggtttgaatgaagggaagcaagtgactcaggcatttattggttgcttacaatcagattcccaccgatgagatcatgcccatgtgtctagaggtccacacacaagcagctgcctccagcccaaccctggaagctgagtgtagtcccaagtccccgcctgcaccccttcctatataaacagccactctcgctgtgattatgggggcatacaaggaagatcaggcttccatggaagcttctgcaactgaaatccactggggactttagaaggagcacctgtaagtagcttcaggatggatggggcagagtctgtctcatggtgggtgttaagctggcctcatacaaaagaggagacccatcctgataccatgccaggtacaaagcactgtgtgatttattctaagtgtcttggtaacaggacttgaagccaggtggtgactggaaacctaaaatgcaatatttagtcatagaacattagaaatagaaagaaaataacctcccaaatcatctaatccatcactcagctaaattcatttaattcacatccccaaactacatctccaaatgtacaatggtttcattcctggtttagggattcgaggttttgtgtttgtacaaaatattttaatagtcttataaaataagatgtccaaaacacaataaacttaaaagccaaacacaagcaaagcatgaaacagaggttctgaagagcaactcctcaatacaaatcaaacattgtcctttatctccattgtgactttcagttatgtaggcacatctgcctttttagatacctaaattatacatgaggattgtaaatattctttgtgtgtatgttaggatgaaaaaaacctgccaaggcaggcgcatgggctaaaagaatacactttcctgtttccttttattacctgtttaattaaaaaaaaaaaaagttgcccctgataaaagcctccaagaaatgcctctagtggtattttctggaattgaattaagcatattaacatattgctatacaaagcggggggcgtggaagtaaggcaaggtggactgtggtgccaatcctagtgacatgtcagcagaggaggagtttcttgcctgtggacttcataaaaggctagctcaacaccctccatgagacacactctgccccaaccatcctgaagctacaggtgctccctcctggaatctccaatggatttcagtcgcagaagcttccacagaagcctgagctcctccttgcaggcccctgtagtcagtacagtgggcatgcagcgcctcgggacgacacccagcgtttatgggggtgctggaggccggggyatccgcatctccaactccagacacacggtgaactatgggagcgatctcacaggcggcggggacctgtttgttggcaatgagaaaatggccatgcagaacctaaatgaccgtctagcgagctacctagaaaaggtgcggaccctggagcagtccaactccaaacttgaagtgcaaatcaagcagtggtacgaaaccaacgccccgagggctggtcgcgactacagtgcatattacagacaaattgaagagctgcgaartcaggtgagagatgatgcttgtgtttcctactctgtgtttagcttcaagataaatcaagaggttatctatgttaggtaggtccaaatggactttgtaaagcaaattaggctaaaatgttacatctataaaaattctttcatctacctttagtgctggagtacctgactgtacaayaggatgaccttaaatcatgctatttttaatgtttaayacaattacatacaaaatatgaacattttatcctcyggaataaaatgaatctttgtcacagcttatcacatcagggctaaatgtatagtgaacaatctttctgaaaagagctaaaaattaattacgtgataaatctctcttagtttttcacctagtccttatcaagttttgaaaccccagtaaattcaaagacttttctccttttatttaagtaaatgttataatatgactattagaatactgtactgcagatttaaatagcaaagtgattctgggtggaaacagtgtggcaggaatatgggtcttaatgatgcctggatttttaagtgccctgtttaataacatgaccatcagcatcaagcagttcagaaactacttctacagtaataaaatgttctattgcccccaattcatgtttattacaatcatatcacaacctcctcctatgtcatcaaaaaaagggtggagctctgtattttatcagtttcatggaataaaagcagaagactttgctcctaattgaaaatttcagatatgacacagagcacttgcttcaaattaaagttcttatctaattaagaaaagtgttcactgtaatttgtgttaagattcatactcctttagagcaaagcgcatttacttaccagcaagtctgtttttcttgagttgtactaaacatcagggcaatttgattcggactccatggraagttactttggaattttagaaactatrggcatgtgaagcaatggcatttaaatagcccttccggaataaagttcatcctyygcaagctctcactaaaaatgttcgaaccacacctgtctcgtgtttctgactctagtttggttcatctgaaatacacaggcacaggccatccgtcccattgagctggacagtcccaaccataggaagcagccctctccaaaactgggtccattgaaagagaaatgtcattgtaacatcttctgcaagtagatttttcatctatatgcctccatcatgcatttcgttctttcatgcatcatgttctttcattcagccaatactgaatgaacactaactaggtgctgggcaccatgctggggactgaggaatattatggtggacacaatatgatttatgaggatacagggatggacagagggaccagcacacagagggataatgagagcacaggcagatcatccagttcagttttgagagcatctgtgaaggctcctatgaagcaatgttgtcgaacctgagacatgagggaggaatgggagttcaccagaccacaggggctaaaagaaatgtcctaagtagaaacatcaaaggcaaggcactcaataaggtgtgatgactcaagttgagttaaattatccttctgtaaaatcacaagaaagtagaccaaaccctggggcatctagagttgcattttatgactctgttatgttaaataactatgtcattattttttctatatattttcatgtagaaatacttgaaatgaacatcatttttgacataatagtcactgtagctggggataaactaaatccttgtaaactcctatccagttgaaaatgtcattcttggccgggcacggtggctcacgcctgtaatcccagcactttgggaggccgaggcaggcagatcacctgaggtcagaacttcaagaccagcctggccaacatggcaaaatgctgtctctactaaaaatgcaaaaattagccgggcatggtggcggatgcctgtaaccccagctactcgggaggctgaggcaggataattgcttgaacctgggaggcagaggttacagtgagccgagatygtaccattgcactccagtctgggcaacagagcaagattctgtctcaataaataaataaataaataaataaataaataaataaataaakmaaaaagaaaatgtcattctttctcatgtattttccagattaaggatgctcaactgcaaaatgctcggtgtgtcctgcaaattgataatgctaaactggctgctgaggacttcagactgaagtaggttccctaatacgtggcaaaagtttctgaaaaagaattcctttagtagtccttccagatactcagctttccatatcattgttgataaaggaagcacggttcaatgtccagaatcctgaagcctaaaggaggttagaagctacatgtatgaagctaacccagcactcagggatggccttctctttcttgatcccccggcatgtaactaaacacctccagtaactactattctccttggttattactggttgctaaatttttttttagtaacctggtatctaaacctaattctgccctttggagtaataacaaagtaatttacaattctccttctccctaagtgcctttctgttatctaaagagagtcttgtgtctacccttggtgattctccaagtaattctccacgttcattcaagtgcctgcaagtgtatgacccaagttccaggggtgactcttgatgatttctggcttgccagtgttttacaggatggtctggccaaccaaagaaccaggaccaatctataataattagctgggcgtgatgccgtatgtctgtaatcccagctactccggaggctgaggcaggagaatcgcttgaacctgggaggcggaggtttcagtgagctgagatcgtgccattgcactgcaacctgggcaacagactgagaccttgtctcaaaaaaaaaaaaaaggaagaaagaaagaaaagaaaaagaaagtaaaaattgtgttcactttctttgtagtcatcacaccacatgtgaccagacctgttccttgcaaacagcttccacactaaggcctcttcatcctgaatttgtacaatgcattaacaccaaaaagccctttgtggttagaagggtagccttttaatgctccaagggattaacaagaaggaaataggaaatcaaatccaaagatgaaagcagtaaaggtgcattacttccaattttacctagcactgagtgtcacattgcagtgtcattttttaaagttggatattttaggaaactgggcagggcatgcatgatggctaacgcctgtaatcccagcactttgagaggctgaggcaggaggctcacttgagtcctggagtttgagaacagcttgggcaacgtggcaaaaccacatmtctatacaaaaatacaaaaaaaattagctgggcatggtggcatacatctsstgtcccagctacttgggaggctgaggtgagaggattgcttgagccccaaaggttgaggctgcagtgagccatgatcacaccattgtactccagcctgagtgacagagtgggaccctgtctcaaatacacacacacacacacacacacacacacacacagtgtgtatgtaagattgtagaggaggatgtagagctgtttgagataattcactttggatgtctctgttcacaaagtaataaaaataaatcgatcatgtacattcattaagtaaaactaaccattatttaatatcaataataagaaccctttgccaacacaataattaacacaatttaatttcttataagataaattctagaatttagaagtgttcaaaattatttcagattgcctttttaccagtcaccccaaattatagagattatattattgagcacattttctgactcctaggttcttatgtaaatttcatgattgtgtaaaggcagacattataaagtattgaaattgatctcctcataagccacatttaaaaacctatcccattatattagattctctccttataatggcttcagaaggaccagttatctctgtacactaattaattcacaggtatgagactgagagaggaatacgtctaacagtggaagctgatctccaaggcctgaataaggtctttgatgacctaaccctacataaaacagatttggagattcaaattgaagaactgaataaagacctagctctcctcaaaaaggagcatcaggaggtgagaaaatattcagaagtggtattggaaacaatggaatggttctatataatactaataataggaggagcgggagaaacaggagaagggggaagagttggtggtgatagtgacagagatgatgackatgacaataatgatacaagccctaccttcttttcataatgttgttgtaagttaaatgacttagagcagcacctggaccacaataagcccaacacaagttattattttatatcttttttacttattcccartgaaagaggtcatgagactccttatgtcttttcwgcccagccttatctgagaatgtgcttcagactaaaatcaatcagaaatttcactttcataggaagtcratggcctacacaagcatctgggcaacactgtcaatgtggaggttgatgctgctccaggcctgaaccttggcgtcatcatgaatgaaatgaggcagaagtatgaagtcatggcccagaagaaccttcaagaggccaaagaacagtttgagagacaggtaaccacacaattctaaagggtgagcaaacgtgtagatgctttcctccagaaacagataactcattttctttttcatttgttcattcttcctttctctttctgtcttttctttcttatttccacccctcaactatttttttttcactcttggcactgtagactgcagttctgcagcaacaggtcacagtgaatactgaagaattaaaaggaactgaggttcaactaacggagctgagacgcacctcccagagccttgagatagaactccagtcccatctcagcatggtaaagcatatctaacttctctttctcaatctagtatgtgtttaccaaggtcctctgttwggaactatagaaatgcaaagacctacaagaaataacccttccccttgcagaactggcagggaaacaggccgaacaactgattataattaaaggacagagagaaatcgaggaaagggcaatgtactgcatgaatgcagaggaaagagtaaatctggaagatttcacagggaaagtggcatttaaaccagatcttyttgtaacttttaagttcaggagtacatgtgcagatttatgatgtagttaaacttgtgtcatggggatttgttgtacaggttatttcatcactcaggtattaaacctaatacccattggttatttttcctgatcctctccctcctcctaccctccaccctctgttaggcccccatgtctgctattcccctgtatgtrtccattataccagatctcaaaatctaagataaaattttaagatggagaatggactagagacattccaggccaagcaaatcagcaagcccatgacaaattatgttgtggtaagcagaatccctcaaaccacagtggcctgcagccatgatactacatccaccgtgacatttcctttccaagggcaaggctaaaggggtaggccctacctaggacatgccagtgtcctggcagaaagaaaagagcaatggttggtccacttgatagctcttaaagcttctccttagaaaaggcatttgtcctttgggaggccaaggcaggaggatcatttgaggtcargaggttgagaccagctggccaatatggtgaaaccccatctctactaaagatacaaaaataagctgggyatggtggtgtgtgcctgtaatcccagctacttgggaggttgaggcaggagaatcgcttgaacccaggaggcagaggttgcagtgagctgcgatcacattactgcactccagcctgggcgacagagcaagactccgtcccaaaaaaaaaaaagaaaaagaaaaggcatttgtcagtttgacctgcattttattaaccaaagagagtcacatgacccagccaggtgtcaatggattaaaggaatctaatcctgcaattgagaaatgccacagatcacatggccaggtctgatgaaggagtgagaggtataacatcttcacacagtggggaagcaagtactgagaacaatgctacaatgcgccgcactgaaagaacagtaggtgcaaagctacaagcaaagaaaaaccccaagagctaatgatcctagctggctggctgaggttgcctagttgggaagagtgggagatggagctagaaatatacaccatgcccacagtgatgaactgcagagacccttctcaaaggaaattaaaattaacccatctcttgaatcaagtcctcacataagaagtgccctatttttcttgtgctcatagaaagagtctttggagcacactctagaggagaccaaggcccgttacagcagccagttagccaacctccagtcgctgytgagctctctggaggcccaactgatgcagattcggagtaacatggaacgccagaacaacgaataccatatccttcttgacataaagactcgacttgaacaggaaattgctacttaccgccgccttctggaaggagaagaygtaaagtaaggctcttagaatcaaggaataggtgtcaatatctgtatgcacttctattttaatgtccctgtcactcattacccagcaccaatgcaatccctaggacagaagcaattatactcacacatgcctcaccacgaacaacaaaacgaaaatataccaaaaaatacacacacgcccaaaatatcaagtacagccttgagatcatgtggtaggactgagttctaccacatgatcatttggagataattctccaaatgatatagattatgctgatattaattttcatcattaatatataattgaaggcataataaccttttggaaattctaattgagagctcatgaattagacaataagctgctgaggtccacgggagccagtctgagaatcataagtgtggcagcagcaactgtcttcagataccatacctaagaatatcaacaagagaacacaagatttaaacttccattgtaattttgttattttaattagaggaacttcttagcatatattaaactggtcagttttaaatctatgtatttttcaagttaaaaagtaaaatgctcaagtttgcaataaaagcaatgtaaaagggaaagatatatgaaagcaataacacattcacttggactttgaaatataaaagacaggagtgcattccattttcaaaacagcaataatgcttttttctgtttcttttttcttcttttcattaaaaaaaaaaacagaactacagaatatcagttaagcaccctggaagagagaggtaagttctaaatttttgcacattttctatgacattcagctgctttctattaactacatgccactgataaaaagtaaagtgaggctgttttagtctgttttctgctgctgtgacagaatacctgagactggataatttacaaacaatagacgtttacttggctcrcagttctggaggccagaaagtccaatatcaaggtgccggcatcttgtaagggcctkcttgctgygtcatcccatggcagaaagtagaagtgcaaaagagtgtccatgagaaccagagagcaagaggaggctaatctttcttttagaactagcccactctcacaataactaacccattatcatggtaaccacattaatccatccatsagagaagagccctcatcatctaatcaccttttactaggccgcacctcccaacactgttacattggggattaagttttccacacatgaactccagggaacacattcaaaccatagcaaaggccaattctcaagggagcagatatgacaccagggattctaaaaatcttgtacatggcataaagaaaccctccacatgggaacttgggcacactcctcagaatggggtgattttcttggcctgtgctattgctatcttgaaacatcctgacatcctgaaraggaaaaacaagacaaaatttgaattccacttaaattcaagataatttatttcttgaatttttaagagtaggacatttgtaaatttggggagaagcacattttctgcatctatttataaaatggacttaagattttttgagaaagaggatgggtttaacatatttttctaaaagaaggaaataagtaaaaagaataataatttaaagttgaatawtataaatcagcagagtcatgtgcctgaattaacatttaatgtttaatatgaattcagatataaagaaaaccaggaagattaagacagtcgtgcaagaagtagtggatggcaaggtcgtgtcatctgaagtcaaagaggtggaagaaaatatctaaatagctaccagaaggagatgctgctgaggttttgaaagaaatttggctataatcttatctttgctccctgcaagaaatcagccataagaaagcactattaatactctgcagtgattagaaggggtggggtggygggaatccyatttatcagactctgtaattgaatataaatgttttactcagaggagctgcaaattgcctgcaaaaatgaaatccartgagcactagaatatttaaaacatcrttactgccatctttatcatgaagcacatcaattacaagctgtagaccacctaatatcaatttgtaggtaatgttcctgaaaattgcaatacatttcaattatactaaaccwcacaaagtagaggaatccatgtaaattgcaaataaaccactttctaattttttcctgtttctgaattgtaaaaccccctttgggagtccctggtttcttattgagycaatttctgggttaatcttattgatttttcagcatcagtacaactctacaacctttgagctatatctgctttttcccattgcttccactgccttttaaaactcaacacagctytttgaataatttgagagtcaaattcaatcacaaatgctgagmmgaataagagtgaagtacactatacttaaaatggaaatagattaaaaacaacattactgaaacccttckcaaggcaaaatgtgtctccttttgataataagctgcatatactatcaggtcctctctttctttatatggtgaacatatatttttaatgaaatgtctctcatttttttaataacagatttattgagatataattcacacaccatgaaattcacccttacaaaacgtacaattcagtggtcttcagtatgcttacaatgttttgcaaccatcaccactatctagttttagaacacttcatcaccccaaaaggaaatcttgtacctattagtagtcaccgccttttcccttcctcccagcccctaacaaccactaatctacttcctgtctctacggatttgcctactctggacatttcatataaataggttaatacgatgtgtccttttatacacaaatgttcatagcagcattactcataaaagccccaaagcgaaacacctcaagtgtccatcaaccgatgaatggataaacaaaatrtaatatatccacacaatagaatcttattcrtcaataaaaaggaatgaagtactgatacatgctataacagagatgaacttcgaaaacatgctaagtgaaagaagccaaatccaaaaacaataaaaacacatattgtatcctcaccctttttgcattttagtgagcaatcattgcatatgaatgtttatgggaaaaatcaatgtgtgctaaatcattgtattccagtaaatagattggacttaaaacttgatacagaagttgcaaataagtgggattgagtttgattattatatagaaaataattacatgattcatttaagaataataatatccaccatttattgagcacttactatgagcctgtgtgccaaacatttcatgcatttctcatttaattctcacaataatcctgtgaggtagaagctattaggttgaatcatatgaacttgccaatatatgataatttctaagagttgggaatttttgaggatgtgaatggtaccactttgaattcctaagatgtaatataatatctaacacatagcaggcacttgattcattattttaaattgaaagaataaagwtttttttaaagctttccaatatatgataatttctgactttcagaaatagcaattttatatgctattatatagcatatataataaggttcarccttattatgttacccccactttacatatgaggataaatgaggactcatatgaagacatgagataaagactttcccaaagtcaagcagttaccaagtagtagagcgagactgaacctcagcgctgtttctctaaaaccaggacaccctcataagcaactaattacataacaaagcaatacatgattcacagttgaaataggcacttgcctatccgcagttattttgttgttttctaattgtcattttcatcagccagacacaacagccaattgtggcaaatgtccagctttgctggctaacatcacacatgacttgattcagtacaacttttgtcagaaaaggtattctcacctattctcattgccttcttttccaaagtgaaragatttcactcatttttttcttaattttcttccaagtcacgctagctagtaagttgcatttaaagatgttaagaatatttaaaagtgaattctttttcacctactgagwcacattccagaatagtctgaaactttgacatgcaaataccagactgtgaatctgattaataagaaacctatgcagatgggtttgtaactgattaggcctgaccactgttatatggcaatgatgacactgtgttaaaagaggtaggattgttattcttaatttaggatggtcctcttttaactacctgttaaaagaagtagaattgttatttttagatcagaaaaatgaagattttttcttcctcttgcttctttggtctgtctctagtttcttccaagcaatctttcaaagaagtgagtgagagctacatacatgtggaccagatggtggagttctacctccagttctgccagcagttactgtgtgaaagtgaagcattaatctttgtatctatctatatttctgatatgagctaagaactagaatgacataatcctatttctgacaggtaaacagatccagagagaagtctttatcacacattagaattatcatcaatgtattttttcattttatatgaaattgtcagtgcagaagtgaagctatcaaactcagagagagcccctagaggtgaggttaggatggaaataactattttttctgagctctggagattatttctacccagagttctgaatcatctaaaaaggagaatgacatggagtgatacaaaatcaaaacatggccagtgacctcctcagacactctgttctcatccacatgcatcaggatcagcctcaggtacctgattagacccccaagtaacaattccaacttaaagcattagtagtgatttttatttttgaattmtctttcaaacatctctgttttctctcccctaggctcatttccaagattcctctcatcaggktattattttatcatcttcctgtctcctaccactttcaaaattctcccctgctttcaagaaccattgatctctggagcccagaagtcaatctcactcataccccttagggtccttgtttaaccctcatctcaaaagcacaatacataaaatgtaggcaacccaaaattctctcagtcactcacaggattttataatgttatccaaagtgaaagatgttacagatcaagggatcagcgagttgcagaaaatgacaggtctgtcttacgggaaaaaactcaggtagaaaaccctgcaaagaccaggacagaaaccaacctgacatgaaaagatgagggtatgatttactcaataaaaatctaaagacttgtaaaaaccacataactaattttctctattttgaacatttcctaaactctacaaaaatggaagatataattcttttgaacagtttgccctggctataatcattttcctctctgcctcaacttatgcaatcactctgccaacaagcccaagattgtttattgttttttacatcaccactgccttatacattaatgtggctgtcaaagaaaattattttcacttctaaaacctctaaagcagagtcttgattatttaacttagcctcccacttaaaaaaaaaaagccactgaagaagaaatatttcccttttcaacttctgaagttgctccccattcataactgaattcagaataaatattggtcaaagcataccagtaaattagggcacagtcattttcaaatgaaatgaatttcaaatgacacattcaaacacattaagacttaacttctttcaaatgaaatcattcaaggagtgcagtgataaagttcagcgaaacactaggctaggactcaggataaaaaataaattagatgtagtacctacctaacaagcttagtctaggataatatgttatatgtatagaaacataaacaaataatatataaacataatttttagagattgagcaatattatttaaattttaccataggcattagagttggaaagtgtacctttcagcacaaaatcaattccaagttcaaaaattcaacttaatcatattcccgtattatgtgatcaaatcactgaggtacaattttgaacttggcacatttcttttgacattttatttgcttctgttttcatttctatggcagtaaaatggaatctctctgtcttgggggacacttgggagtgaataatagttaacaaccataacatcaagttcttgtgtggggagtgcaagtttaacttgtgctttataagatctctggagatgtagttacaggtcaaagctaaaatgaaaaccgcatttgcctgtgtgtttacagaatttcatgtgtcatgttgttgcttataagccatgaaaagtcattctctaggtctcagcccatacactgagaaattcaaggagaaagcttaaaagaaaagaaaaaaaaaagagcacctcctgttagatgtgcagggcagaagcctagtgtcaggtgtcatagctaggggatgtcagagtatcctctgccctttttattgtcaccgccagcagcaaggttgtggtatctatagaaggcactgcaggcccgaatcctatctctgcctcctcccagctgcatgggcgtaaataaatcacttaacatctggactctcagattgctcatctgtaaaataggataaaagtaccacctgaagctgggcgccttgaggtggctcatgcccgtaatcccagtgctttgggaggccaaggcagaaggatcacttgaggcctaaagttcaagaccagcttacgcgatataacaagactccatctctacaaaaaaattaaaaaaaaaaaatagccagtgttgtggtgcccacctgtagtcctagctacttgggaggctgaggcaggaggattgcttaagctcaggagttcaaggtttcagagagctatgatcacaccactgcactccagccggagtgagggcaaccaagcaagaccttgtttcaaacaaacaaacaaataaaaccagtaccactttaagagcttgccgtgaaggttaaaaaataatgtctgtaattcagctggcccagtgtccaaaaagtagtaagtacataataactgataattcaaacaagaccagctcagtcaaaatgcttataatatagatttaaggaatccttggtaaaaacctccatatggggctaaaatcactggcatttccactgaccagattttcattctctcaagaaattaaacaaatggatcatggcttctctcaagctgagactgccttaggttgctacattctttccacatctatagcaaatgtgtgatttctgcaaatctcttgcttaaaccccctttatttagaaatcccacttgcttgctctttgtgacgagtttaggttggggagaaatatgtcccttcacatttgtcccttatgtaataatataaaaggaagttgtaattggatttcaccacgggttcatcatttgtgtccctgggaaagtggcttttttttttttttttaataaaaagtcaaaacagtccttccatttgccagaattgatcccaggtattccttatggaggtttgccatgggcttcaggtgtgacccctcggcatctgtcccctaatccccagtgggcactgctagttctggctcaggactcttcacaatggaagaacctcagcttcggggaggctgtaatcagggagataatatctggatatgcaggtggacaggaggcagcagtaaactacggggaatctaggctacaggtctggaattcctcaggagtcagtctgtactctacaaggcaaaacaagtgctaaccattgagactaactccaatgagataaaggccagcgaaagaagcattctcaggagaaagggctcccagggaaggtggagcagcaggggctgcagaagatccctctgcagggagcacctgcacactggcaccaagcaaagacatctgagtgcatgtttctgggtgtgtgtgtgtgcatgcacgtgtacattagaatgagagtaacatctgaatgtgtctacattgtgaatccacgaatacttaaattattatactttgtagcttgcctttatattgatacactcttttttgattttggaaaaatttcctcatacataacacacattaatggcccagcagcttgatttatcaagagagaaatcaataagcatatattgaatgctgactttgtccaagacactgggcaaatggactagacattgaagaatggaggtaacagcaga

SEQ ID NO: 12476 - DNA, 13066 bp, Homo sapiens
actccactctccatggcaccaatttaatatattagtccattctcacactgctataaagacatacccaagactcggtaattcataaaggaaagagctttaattgactcacagttccaggtggctggaggggggagcctcaggaaacttataatcctggcagaaagtgagagagaggcaaagacacgtcttacatgaaagagagaaagaggaagagcttgcaagtgaagggacaatggccccttataaaaccatcagatctcataagaactcactcactatgatgagaccagcaggtgcgaaactgcccccatgatccaatcacctcccaccagatcctgtccttgacacgtggggattatggggattacaattcaagatgagatttggtgggggatacagagccaaatcatgataaatctagtgtgacttcatgttgagacagagtcagtggcctcactattgaatacattagcctgttctttaccacactcgaaaattagccttgctagtgttctctaattctctaaggggcatagcaagagtgatctgtgccacagttcccaattcgttctgctccactgagatgacagtgaagttttgagcaatgtagttaacactagagaatatgttcacattgaaaaactggaagaaaagggcaagagtcactatttaaattccatcccacttttcaacattgttacaaatctaataaacacatattttataattgaataactacactgcataagggagaaaatcaccaataaaaaaatcatgtggtttgattttaaaaaatgaagcttagagtgtttggcaataatacctatgttaataaaaagaagtacagaaataaaaatacaaaaggatcaagtcatggaagttcatatgcattcagtgaatatgacataaaaaggctgaattctctcatgaaatacatggcacaccaaggaataagaaacaatattcaggtcccagagtaccacatcaatgaaccccaaatattctggattaaagaaagctgcctttgaaattgttggtaaagaagtagatcccactatagaaacttggagtgggatagggtgggtttggtgatatgttcagcttcacctgagaaacacttcccttcttggacacatgtccattcatcaccgtccccagcttaactgggcttatacgctcacagttttatctcctccctagacccttccacaatttcttgataatttcagcattccaagtagaagacccaattgacctgcaaccaaaactatgccttccgaactctgagatgtccccacatcatgcaccagaccccaaatcctgaccagaaaaatcttttgtcagcacagatccctctctggaaactgaactcagtgtgtaattctataatcacagacatatatcccacgttcgttgctctacttccactgaactgagtcaacctctttaacacttctacttcctgcgagtgcttaggtctcctgtggtcacctctctatcattcgcaagacaggaccactaaaaattatcacattaacaattgtaatttgctgttgcatcatctttcccctgaaaattgtgcaaacaaaaaatccagatgggtcaagtctcaatgtagtgtccctgctccttcccaatgaaggacatgcacaaccatgaagatggtgcctttacaaacgaacagtctccatgagtcacatcagtcctagtccatcctttgataaacattcatgtctgcctcttcttcctctcattgaccatttaaaacctgaaatacgctactagagaccccttaacagtttatctcactgaaggctattacgacaagcagaaataaaagcaccagaaagataagtagatatggaagcaattgtaagtaaatacaatttttaaaaactgttttgcctggaacattgattggatgaaggcacgaacaccgacctgagatagtggcttcctgttggcacagttgatgcccccaatgaagaccatgttgggcatgatcggcctggggtaatccatcacaaagtcccctcggaacagccacacagatgcatggctgagaagatccaccactgacacctccctctgaaaaagctcagaggcaaggcttgcataaggagcagaaagagcatggcaaaggtaggacagggccagagggtagagcatgttcttgaccctttgcaggaatgtcatgtggtctgaattggtcgttagtaacttaggaatataggaggaaggatttggacactgtgtgcccttaaagtctaaatcacatggaatgttcctcaaaaaaaacacagcaggaattgataggtacttagccagcactgccccacagaggtaaattgggtctattaaaaccacatcgaaggaagtagcattcaggtgcctgatcagggcctcattatgcagtagctccacacaagacctatgaaagaccaaagatgaatttttcaaaattgccatacttttagaaaatgtcttcagaaaatgttctgtttcaaagtacagttgagtgtggcccagcacaaggcgatcaaattcatcctgggtccatgaaatggcataggttgtcagggtgaaaaatttctcttgtttgatgtgcatattcacctctggggtgaggaccaccgcctggtggcctctggcatggagctcccgcacggcctcccgcatgcgagccagtggctgccatcaatgggtaccaccagcaccttcccactctcagcccagggctgggcactgagaaggagtagcactcctgtggccagccacagcaggggaacctggggtcctgtggccatctcagcagaagacacggacagctgactgtccaccccacgctgtgcctcctacatttgttttcttcatcttaattaccttgtcactgagccacttagcaaatcatcatgtaattggaagatagagtgctctcctcctagttaattattaccgattaaccaatcattgtctttcattatgggtcccacttcgggaaagaccgatcactcctacttgaaaaactcatctgaccctgcgctcgctctggggaacatccaagttcaagctcttgtttctcatccaattcccaacaaaggcctgtggaaacccatttcatgtcacagcctcctacttctctgttaaccacgtttatcaggctgcagctgaggtctgagaggtccccaacagtggtaggcaatagtaggcaatccacattcacgctcatgaattacaacagaaaaccactactaagcaatccaattaatctctgctttggaaccaaagcagaatccattgctaattcccttatccaccaaatatttatggaatgtgtgagccctacctactatgctaggaactcgggacagaaagccaagttagaaatggtccttgcctgaaaggaggggtcaggtgaacagagacaaactcacaactaggcaattacagggtgtggtgctctaggggctaagaagtcacacagcagggcagcaatatgatggtcttgctttgggggctactaaagagtgacatgtccatggaaagtgtttctggaacccttttgaaggtactttctttttaagctgaagacataagttaataggtcaccattggacacactcccagctcctttcatcaaatcagaatgaagggacttgttactaaaggagcaacataaacatgtccattgccctgtagatcatctacagggccctccaagggaaacaaagccaccttccttgaatccccacagcgttttgttctgttctgccttgtatcttttagcagtttgcatatctgtccttgctattagagtatagctatatcctatacatatattccttacaggcaagattttggctttggaatcatgctatcactcaggtgccagtccacagttttgcagacagtaagcactctggacatgtttctgtatagaagtgactcctcttctcttttcgttctagaccctgcatccaagccagcaagtaagtgctgaatctggatgtttctaccactgtctctcagacccagctgtcatggtcccatttcagggcccctgtcccccagttgcccaacccccagctgtcccttctgaatcactgcctcagctgctccctgaaaaacgccaccccaccaacacttctggaaccttggtcagcagcttcctgggcacagaagaaaattcagagtcctctgccttgctctcaaaactctgggatagaccccagcccccctgtctaagctcattcctcctctccaccccttctgcttgccccctccctctgcctcttaccctccagccattctggatcacttgttgttctccaaacttgctttgatgttcccaaattgctttgttcacactgaactctaccctcggccagctttctatgactgttcattgtgtgcttaccaagtgccaagtccgggtctcaggttatgtcactagaggctatataaacttagaagtttgttctggtgacataacacatccccattagacctaataccctataggaaatcttagaatgttctttggttaatcattttccccttagaactgagtgacctttactagtgtattgcctcacaatttatcaaagaaaagaatccagtgtcaaaaagagaataaggaggtgaagagaactcagatctcaaaaaaattcccccaaaattcatggtcatgatatagcagttctagtggaaataatcactgcatcccacgtttatccccagtgctatacacacggcctgcaagtcttaatggtttcgatacagtaaatagtgctgtatttccttttgtctgagaggatctccctggttgttttagcagtcaagaaaagtgaataacatgcacatttgaccctccatatacttgggcttcacatctgcagattcagccaacagcagattaaaaatatttggggggaagagcaatgaaaaaacaatacaaataatacaaataaaaaaccaatactgtaaaacaactatttacatagcatttacatttattaggtaaaagtaatcaagagatgactagaggcttaaagaaggatattggtaggttatatacaaatactgtgtcattttataaaaggagcttgagcatctagattttggtatggagaggagggttgtcctaaactaatcccttcagaataccaaggactactctgctagactagcgattctcaaagtatgagccaggaaatcctagggatccccaagaatttttcaggagaattttgcaaagttaaaactatttccataataatgctacttgattttttcaccgtcattctctcacaagtgtacagtggagttttccagaagctacatgggtgatgtgtaatatcacagtagattgaatacagaagctgacatgagaatccacctctctatagagccaagtactaaagagagatgcaaaaactgtaaaacgatgccactcttctcactacattttgtcttaataaaatttacataaaaataagatttgctattgtgtcatgggtttattcttactaaattgcccaattaatatgtctttttaattctgttttaatctctaatgcagtacgtatgatagatataatccacatgaacaaaagcaaatgggcaccggggctggaacgttggagaactgcagtcctaaacaacaggatgtcttcagccccagtcagactaaactcactcccaccaccctcttccctcctgtggccgaggaaaaagactgatataaagcctactttaagaaaaacagttcttcaggcagccaaagtcaaggccctctcttttccccaacctctttttcccatcctttttggagaccatggctggttggaggccggagtgggcggggcctggtcttggagcatcacagggcctcacagagcctcacagagagcagggccagtcccagaagcactgcatcttgggatgcgaggcgctcataggcctcgaccaatgagatgtggctgcgtcataaggggcgtctctccaggcggcccaggtctccgagcactcgggcctgcrcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggagaggagattcaagcaggtggccgaggcctacgaggtgttgtcggacgccaagaaacgcgatatctatgaccgctatggcgaggcgggsgcggagggcggctgcacaggcggcaggcccttcgaggamcccttcgagtacgtcttcagcttccgcgacccagccgasgtcttcagggarttcttcggcggccrggacccattctcctttgacctcttgggaaacccgctggagaatattttkggggggtcrgaggaactgctggggaagcagaagcagagcgtctgcaccccttttctctgccttcagtgaatttccagcttttgggggtgktttttcttcttttgatacaggatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaayrgcawagagcagttrctccscattgacaccaagtaattccagtccacatttgactttaagcacatctggaggaatagcggactttttttaggattgaaagtgaactttactttcagaacagctgtacccaagaatttataaacacttyatgccaayrcctgttcttatygttgggactrcacggataggacctctgtttgtctttcratcrttgtaaaatatctgtatgcaatttgctatttattaaacttaagcctgaggcagacaatgattatttgctagtggtaggacagaatgttcagttcagcactttgagcattacctttttccgttgggaaagtgtgagccaggtggtttgctctaaatcatttgactttattgtttagtgtgtagtggtgaaatctacaaataatatcaatacttctggcttaatttaatgatggttcaaaacaacatgcatttattatcttaatattttggaggtcagacatttgaatcccatatcactgagctgaaatcggtggaagcatgttccctctgaaggctgaggacaaaccttggggttacatggttggtcggtggtatactaggactgtcttcagcctgaacgtggttctccaactatggtaggttgctggggataagcccccaattccggccagaagctggcccctaaactggccataaacaaaatctctgcagcactgtgacgtgttcatgatagccatgatgcctatgctgaaggttgtgagtttactggaataagggcaaggaacacctggcccacccagggaggaaaaccgcttaaggtgttcctaaactacaaataataacatgagccatctgtgccttaaggacatgtttctgctgcagataattagccagagcccatccctttgtttcccgtaaggaatacttttagttaatctataatctatagaaatgatgcttatcacaggcttgctgtcaataaatatgtgggtaaatctctgtttggggctctcagccctgaaggctgtgagtcccctgatttcccactccacactctatatttctgtgtgtgtgtctttaattcgtctagcgctgctgggttagggtctccacgaccaagctggtcttggcagtgggtcctggaaatgtaaaaaaaggatctccataaggccacacagaactatcctattgctatgcttgggacatatcaaattaggttgatgaaagccaagtgtatctgtaatattttttgggtgaggcaccataaacacaacaagaaagtacctttctgttggcacaggttatgccccaaatgaagaccttttccatcacaaagggtcccttcttctagggtcacctctgaggaaaggtttgcataaggcatgagagcaaaaggcaactgaactggataggctgaaaaaaattaagagcagcatgctggtaattttttacagaaaaatcatggcctgaacacatcattaaccaacaaagagtgtgatatgggtttggatatgctctagaaccctcagagtccactctgcatgtaatggcacccaagcaataaacagcaggaacatggcagtcagctggcaccatcccacaggggctcatggggtctgacactgaactctgaaatcaacatgctccgaggtgcctgggtagttgattctcatacaataaccataaaagaagtatcagaataagacagactgttaaggcttttgaaaaatgagttcagttttttgtacatcagacgagggaacttacatgtgtgaagatactcactgagtagtttgctgagtaggtttgcttttggagcagttcagggatgaaaggagtttcaaagtggtagaaaggcatgggcagtttcattgtggttttgtgtgttggaaatcactactctgggtagagtagaatgagttggtgtgtatctacacaattgggtacataaatcccattgttcagtggtcagcaaagagtggcataccagtgtcactcagaggtagtgggtctgtaacaactctggctagttttaacagttgaaagcaaacacaagttcagttttgatatatcctggattagtgctgtcataaatggaaagtgttgcttttatagaagtgtaaagcttgattgtctgtttgcttgtttgttttaaagacagggtctcgctctgtagctgttacctaggcaagatcatagcttactgtaaccacgaattcctgggctcaagtgatccttcctcctcagcattcccagtagctaggactacagaaatgctaccacacctagctaattaaaaaaaaaactttttgtggagatgggaacaatgttgacctactatgttgtccctgcaagagcattttatttaaagaatttttagaattgaaaaatctccttttaaaatgtctcagctcaaaaacagaacagtgctagagcctgttatgtgggtattcatcttttatacaacggtttgataaggttttcagagtgtaaaagggggcatttcctgtggtgcaaagatgaccctcttgaaatccctaaaatgaacaccctccatggaaacacctgtaccttctcaccaagtacactgggcaaggaaaggcatgaccctgtgagccccaagagacctggagacctgtaaccatttcattagggtcccaaaaaacaaaatgccggacattttttctggctggagttcaacacagctgattttagttcagcttacatcacacactggaaagcatctggaagagggaatgatcctttctgtccatcatcttcttctcctctgattccactttctgtctccaaacaggtagagagacttccccattttgggaaataattcacacaacaacttacctttctaggaatttctaattccactttctcatcaactttctcaataaatgcagattcatttccttttctcagactctcctttaaaccctttcagtataacttcaatcaccaccaatcttgtattagtctattctcagcctgctataaagacgcagctgagactgggtaatttataaaagaaagaggtttaattgactcacagttccacatgactggggaggcctcaggaaacttacaatcatgacagaaggtgagagataagcaaaggcatgtctcacatggcagcaggcgagagacagagaggaaaagcttgtgagtaaaggagaaagagtcccttataaaaccatcagctctcatgagaactcacttagtatgacaagaacagcatggggaaaactgccgatatgattcaatcagctcccaccaggtaccaaccttaacacatggggattatggaaattacaatatgagatgagatttgggtggaaacacacagtcaaatcatatcattctgccctctggcccatcccaaatctcatgtcttttcacatttaaaaaccaatcatgccttcccaactgtcctccaaagtcttaactcatttcagcactagctcaaaagtccatagtccaaggtctcatctgagacaagtcaagtcccttcccccatgagcctgtaaaatcaaaaacaagttagtaacttccaagacacaatgggggtacagaaattgggtaaatgttcccatttcaaatgggagaaactggccaaaacaaaggggctataggccccatgcaagtccaaaaccaggcagggcagtcattaaatcttaaagctccaaaataatctcccttgacttcatgtctcacatctagatcaaggtgatgccagaaatgggctcccacggtctcaggcagctccaaccctgtggctttgcagggtaaagccctcgtcctggctgctttcagagggtggcattgatgtctgtggctcttccaggcacacagtgcaagctattggatctgcccttctgggttctgaaggactgtggccttcttctcacaactccactaggcagtgccccagtggagactctgtgtgggggctccaacctcacatttctttaccacccttctctagcagaggttctctataaggactctatccatgcagcaaacgtctgcctggacatccaagcatttccttacatcctctaaaatttatgtggaggttcccaaacctaaattcttatcttctgtgtacccgcaggcccaacaccacatcgatgctgccaaggcttgaggtttgcaccctctgaagcaatggcctgagctctaccttggccccttttagccatggctggagccactgggacacagggcaccaagtcctgaggctgcacacagcagtgggggcctggacccagcctaaaacaccatttttccttcctaggcctccaggcctgtgatgggagggtctgctgcaaaggtctctgacatgccctggagccattttccccattgtcttggtgattaacatttggttcctccttatttattcaaatttctttagctagtatttctgcatctggcttgaatttctccccataaaatgggtttttcttttctaccacatggtcaggctgcaaattttccaaacttttatgctctgcttcccttttaaacataagttccaatttcagatcatctctctcaagttcgtagttccaaagagctctagggcaggggcaaaaatgccacgagtttctttgctaaagcttagcaagagtgacctttgctccagttctcaacagattcctcatctctatctgagactcagcctggacttcattgtccacaacattatcagcattttggtcaaaaccgttcaacaagtctccaggaagttccaaactttcccacatcttcctgtcttctgagctctccaaactgttccagcctctgcctgttacccagttccaagtcacttccacattttcaagtagttttatagcagtaccccactctccatgacaccaatttactgtattagtccattcacacactgctataaagacatacccaagactgggtaatttataaaggaaagagctttaattgactccagttccatgtggctggaggggcctcaggaaacttataatcctggcagaaagtgagagagaggcaaagacacgtcttacatgaaagagagaaagaggaatagcttgcaagtgaagggataagggccccttataaaaccatcagatctcataagaactcactcactatgatgagattaggaggtggggacctcccaccatgtcctgtcctcaacacgtggggattatggggattacaattcaagatgagatttggtgggggacacagagccaaaccatattaaatctagtgtgacctcatgttgggaaacagtcaatggactcactactaaatacactagcctgttctttaccacactcgaaaattagctttgttaatgtggaattcttaaggggcatagcaagagtgacctgtgccacagttcccaatttgttctgctccactgagatgatagtgaagatttgagccaatgtagttaactctagagaatatgttcacattgaaaaactggaagagaaaaggaaaaaaaaaggaggtgttggagaggagaacggaagcttcagcaccaatggccaaataggaacagctccgatctgcagctcccagcatgatcgacgcagaagatggatgatttctgcatttccaactgaggtacctggttcatctcattgggactggttggatagtgggtgcatcccactgagggcaagccgaagcagggcagggcgtcgcctcacctaggaagtgcaagagggtgagggatttccctttcctagacaaggggagccatgacagactgtacctggaaaaacgggacactcccacccaaatactgtgcttttcccaaggtcttataaactggcagacaaggagattctctcccctgcctggcttagcagctcccatgcccacggagccttgctcactgctagtgcagcagtctgagattgaactgtgaggcggcagcctggctgggtgaggggtgtccgccattgctgaggcttgagtaggtaaacaaagcatccaggaagctggaactgaacagagtccaccgcagctcagcaagggctactgccgctatagactccacctctgtgggcagggcatatctgaacaaaaggcagcagacaacttctgaacatgtggggaacagcagacttaaacatccctgtctgacagctctgaagagagcactcgttctcctagtatggcatttgagctctgagaatggacagactgcctcctcaagcgggtccctgacctctgtgtatcttgactgggaaacacctcccagtagg

SEQ ID NO: 12477 - DNA, 60217 bp, Homo sapiens
  misc_feature (1)...(60217): n = A,T,C or G, or insertion/deletion polymorphism (see Tables 1-2)
gactattcgagctctactaaaccactctaggacatgccttctttgggtcatcaaaaatcaactctcctcgcctaggttttattcttgccaacttagcattcccacggcaattcactaaaaacgccttaaaaaatcattagctctcatttattcaacttgaacatcagcatggcctgaagctcgggaagaaacagactggcatagtgacgctgccagcaccaagtaaagttttacctcccagcgctccaggttcccagcaagacttccagccagggctgccttccactccatttcagcctggcaccctgactctcgctctaccagctgttggcacgccttgtgttaaccgagaatttgtgagaaaagcagaaccttcccactgcgtgttagttttgcttggcaacactcaacaatctcaaattggaaggccccaaggaaaattttttgttgttgttcttctgcccccaggatgattttttcttcttcttcctgaacctgtttggatttttttccacttaaaaaatctagcagcccccacctaactgatggatacttgtaggtaaatgactctatctgagcaatgatgcgctgactgggcctataaattatgacccattgtggttagttcaaataaaaggaggttccgataaaggaaaactgacactcggaattttctctctcaaaaaggatgatgtctagggatgcaaaattcaggaatataaagagagaccttgcaaatgtatcaggctcttctaaaatacaagggattggtataaaattgtcctggtgaaatcaaggggaagcacacaggactaaggaaagagaggcaagaaatatatttcttctcctttgcagggaaaacactgcattgggaagaagcttgctctttccaaatacattccattaaattgacaaccacagccaccactgccaccacaacaaaaatcaggccaacctagatcaaattactaggaataggtctaatgttacttttatgaccatgaggtcctggccctcatcagaacctctgggttacccgtcctatcacttggtaatgaatttcatatatgtatgtgctgttaaagcaaaaaaaaaaaaaaaagtaaactcataaataattcatcacactgtctcctgccaactgatcatatattgttcatgtttcaccggccatattaaataaaaatttaaaagtgtttccgtttttcatttaaaaacctagtctataattggaggtgaccacacgaagtgtcttgaaggtagcaggcattaaaaaaatcattacttaaattgcacagttaaaaaatattcattagaaatggctaaattaaagaaaaaaatgttagggaatcttagggaaatgtttctcctaaatgttgtccctaaaactgcttcactctaaaaatctgttttgagcgacctgataaaagggaaagagagagtttcagctcaaactcaggaaagaaaggctgtaccagtttcttcagaatggaacattaaaacaggccactactgaaacagttcttgtgcctttgtggctaattattacataattgatcttaaaaaaatttttttaagtttaggaaaaaaaattagaagcctagtgaaagtaccaaaaacactgtaacttttttgtttaaaaatttatatcatgaatcgaaaatcagaggagatggccgttttggcctggtctccgtcctttccttctctattttgattgagccagtcccttgttaagccatcagaaaacagagcacacttagagctcttaaactgctttagacacaaagaaaaaatttaaaaggaaaaaaaaagcaataatcgtgtgacatctcagagatgatagcatatactgttgttttgcttgatgacgataacacaattctttttgaactaagtatctctctagactacaactgggtcaaaattatagatattttttgtggccctggatgaattttctatttgccaaaactcaaaggattcaaaaccaggttgatgtctagttaaagatgatgctccaactgcttgagatgctagttcatttcaacagacattaagattgaaggagtgtcatagattgcttaggcaattagaaatttaaaaccgtttcaaagaaaagaaaaaacaacaacaacaaaaaagttatgccataggaagcatgaagcctcatttactaaagtggagaaatgtattttattttattgtccttatggcgttgattgccagttctgacacatattacaaatttcacattgtttttctgaatgctgaggtcagacctaccataagcttgtcccgttgtattaccaaatggctaattccctcccaggtattggagaaaaaagtcagaagggcagcatcctaagagaatgggtgcccagtatgacaaggagctgctaagataaaatgaactttctaactaaaaacagaaaagaaactataaaattgattttaaaatctgcaggacatttttttaaaataaaggataaattaactatgaatatattgagtggttatgaaactaatatatcttagcataacagagtagagacagctttaacttttctatgatactcatatagttatattttatgatgctctaataggtatagggtacataatgaagaagaagctgtttgtggattcattgtattttattttattttattttttactgctttgagtatgaagagtctgcccaaatatactacttataaatcataccaaaagtgcatcagtgaaaaccacagttccatttcttaggggaaaaaaaaaatcaagaatcaagttttagaatccaacgatcacattttccttaattacaaacgaagacatcatgtattatttttctgtatccacaagagatgagagaaatgtaatttttatcgcatgttaagttttcactgaatcacagtattattaagctttaaatcagaggattgtttccttcagctaagtctaacaatactagaaagtaaaagggggggacaacccccacctcatctggggctgcaatatttgctgaaaaaaatctacttcaaaacattaatcaaatttttcgcccactgggcaaccatatggtacagcagcatgtgaatctcacaaacttgctgatctcctgtaactgggtgcaattaattacgctggctgcatccatctcttggattttcgccttgtgaaaaaagtatttattgcaacagcttttacaaaacaagggaatgaaaatcacaattgattaatgagctgaatggaaatatttccgttagcagatttttttaaatgaataaggattaataccatggatgggaatgaacacacgtcgatctcgccttgtactttttggacccccaaaaaggtggcaaaagagtgggcagagacggtgctgtgagttctaacatgcataattcactagcaggctttaggtcgcaagtaataaagccttaaaactggtgaagtaataaagaggctggctttacaagatactatcctgggagacagaaagcttgttctttgatgtgaaaacacagatattaaatactcagtgggtgaggaacattacaggcctgacaaagaagagaaagggaagggctcttgaagtaagcaacctactttgtcctcagctatttaggtgcaaaggttgctgcacatatgggccgattactgttttaagatccctccataaaaccaagcatccgagagtccgtcagaatggtaccactgtccttacctactggctaaaggcacaaacaatgcataattgcaaaatcttcccccagcaatgttcagccatcatgcacttgactttgcttaacagtcagacctcgttctggtgctgagccatcctacggggcttcatggagcttgtttcttgatacacatgagggtcgtaatccctcccttctaacttaatttttttttttatttttatttttcagagacagggtctcactctgttacccagctggagtacagtggctcactataatgttgaacttctgggctcaagtgatcctcctgcctcagcctcccaagtagtcctccaaaggactacaggtgggtgccacccagcccggttaattttgttttctctttttttagtagagacagggtctcactgtgttgcccagggtagtctcgaactcctggcctcaagtgatcctcccacctcgcctcccaaagttctgggattatagatgtgagccaccttgcctggcctcaatccttcccttctgagggagtgacagatccaaggctgacagtctataaacaaagcagaagcagatgcactttgccccttttcagaagtgccctctgggtttaagtccaccagctagccaagcattaatgacatcatcattacatgcatgcctatttcagaaagatcagttccattttccctaaatagacagcagaggagaccgcttccaacattttgctagttgttaaatatgtatcttgagaaaacgaaactaatactaaacataatggaagaaatacgtaagtttgaaagatcaaatatcgtatgactcttgaaacagataaaggaaaaagctgttaggaccaagctttgtaagtcaactcttaagccaacccttttctttactgcatctattgcatttaaacttctaccaggaaattctgcaaaggacttggttaaagagaatttactattattttattaatgcctgcagagtgtgtgtggctagtatgatgatttctctgctcaagtttgttgattgattttgtagaaatgtccacaggagataaaatctgcaaactcctcaaagatgagactgtgtccaagaaaagagtaatgatactttataaaacaagaagtaagtgacatttgaaacgatggttcatctcaaacaacacatttcctctgagctccatgtttatgttaacatgtaagtttgggaatgctgatgtaatagacaaagataactcttgccacttcaaagtagcaggcatgcctaggtgggcaagaggttcagaaagccagcacttaaggtgttgaaggggtaatttttaaaaatcttaagaaaatcattccatttgagaatcggagccaccttacaatcaaagaagccactgttttgaagaaaccactatcctgcaaaaagtagacggaagttaccaacaaaaagtacttggctcccgaagaagaggaaaatcagatgggaacgggttgtccaaccccttaaaccagtgaccctacaaagtacaccaccacccaccaccacctctcagatgatctctaaacccctcctacacgcaatggttgttggcttaaaagtttaaagagctaacaaaatgttttaacgagatacaaatctcagagatcattaatcaatatgttcaatgttatttgtgataattcatcatgacgtgatattaatgggttactgtacccttcagaggtgagattaatgcaaatgagctgccacaattaactttactgctcccacctcacaggaatggacagatgattataaatgacaactatatgtcaattacaatatccaataaagtgaagcttagagaacaatccatctccttttattgctcttccttgacgtagctgaatttagctcaacccactgttgtcactatgtaaccattgtttgggggagggaaaagagatttttcttctttttttttttcttttttaatttttcgatgtcttaagaagtgcttcaaaaacgtccatgtaaatacgttttctaaaggaggagagccacaggaaaccaggaataaatgccacattcatcctatgtgagttaaagaaaactgtatccgttttcaaattgtagcagtaaggccagcaaggaaacaacctacccagctgtgtataatatatttactcaattaaaaaaggaagacattagcacagcatcctgaaaagccttgagtttcactaaacaaaagttatttgaaaatgactccatcgaagtaaataggtcacagagtggaaagcaggtatgaggccgagggcgggatgaaaggtttgatgtcagtctgtacacctgcacttggaggtgtggagtggggagcaggtcagtaaatactacagtgctggccctcacagcagagaatttctgtgtctgcatcgttcctccttgcatggatggagtgatttttgacagcagtctctctggtgaaggtaggcacgttgtcatgttgcctcctcaacccagattctcctgccgggctggtgaacccagaagctgtaagaattagctagtatctcacagctaccccttcctgccccannnnnnnnnnnnnnnnnnnntatgtccacgccgccctcttccccagcagacactggctcatcgctgactgccataggtcagccaggccctggtctcagtcaggaccaactctgctgtagaattcaccctccagagcttcccgtgggatcaagctgaagctgatcttcagctaagccacatccttcctggacattttccctgtccttttttttttttttttttttttgagatggagtgttgctcttgtcactcaggctggagtgcaacggcacgatctcggctcactacaacctccacctcccaggttcaagcgattctcctggctcagcctcctgagtaactgggactacaggcgaacaccaccactcccggctaattttttgtatttttagtagacatggggtctcacatcatattggccagcctggcctcaatcgcctgacctcgtaatctgcgcacctaggcctcccaaagtgctgagattacaggcgtgagccactgcgcccggccacattttccctgttctaagccactcttctcatttcctttctgaaagcatcctgacccccatcaaatcagtggaacaagaagactaccttgacctgtgcttccaggtaacagaacgcaaggcaggtatcaatgagatggaaacaggaatgctcttaatgcagtgcaatttacaaaagaactgttctttgctgaccactagtaagagaccatccaacaggctcctttctgaagccacatcccgaaaagatcccctcctgatgtctctagaaacatgcaaaaataaaaytgcaacgtcagaaccataaaaggatcatagcagattgacggtagaagctatagatttgtgtgtccagaatgtttccccaggtgcctccttttgcaaaattggacctcattttwccattagggaacggggcctctcagactcygtggagaagcagagaattatctccagccttgactgcccaggctgcagagaaccgcatcatccggggacatgactgattcagggataggtgtctgcctaaaactaggccaatcctggttctccctgtggcttttgggccaagggtagtggggaaaacagcttcttgtcactgggggaacaagccaagatgggacagtgctcgyctgccagtggcagccccattyggagagaattttccctttgaagaatataacccataaaagatcatcaaaactaagggawtaaataaagaggggacctcgatgacatatttaagctctgaataaagctagactctaagcaggggttggcaaactataaccgctgggccaaacacggctgtgttcttatacagcacacaggctaaaaatgcttcacatttttaaatggttgggggcgggggggaaagaataatattttgtgacacatgaaaatgtatatgaaattcaaattccagtatccataaataaagtttctcgcagccatgcctgctcctttacatrtcgtttatgcctgttttygcactatgagggcagagttgagtagttggcaacaaacactacaaggccccaaaatatttattaaatatcccatcacagagaaactttgctgactcttgcacaaaacttcgcattttgtcagccagtaatgaccctttcctcttaagctagtttraatttggagctttttgtgtgtaagaggaaactcctgatctactaaaagaaaaagctattcttagtccttcccagatatccctgaacctccacccacccagtctgctgggatcctgatatagtttggatatttgtcccygcycaaatctcatgttgaaacatgtccgtaatgggaggtatttgaatcactggggcrgagccctcatggcttggcgctgtcttcaccatagtgagtgagatctctggagatctggtcattttaacccttttcccatttgccccaagaatacttactggtgtgcagtgtttaccctgagatcgctttgccatgaaatatctcgcttttattatttttttcacatcactctagcatatcgactttggaaacgaaggatatcattctatttatagccttctgtttttagtagtggtatttccatttacaaaatataatagttctccatcactgaaaatgtcaaatccgagaaaatgtagcattcctgcatgtgatgttaacatcattctcgaacagttgttggctgaagattcatttgatgaatccgatttttccaaaatacacaattctgatgattcagatgattctgatgttagttctgttcagaaataattccaagaactgtttttatattttattatcactttgaaaatcggtcacatttgcttcagcttcaaagagcatgtttatgtaaaattaaatgagcgctggcagtgagctgcgctttttttttcctaaacaggaaaagggttaaaagtggggcacctcccacccccaccccacgctctgtcacttcccactgtcaccatgtcacctgctgctctctctttgccttctgccatgattgtaagtttcctgaggcctccccagaagcagaagccgctatgcttcctgtaccacttacaaaactgtgagccaattaaacctcttttcttataaattacccagtctcaagcatttctttacagcagtgcaagaacagcctaatacatatcctacaggtaacgtctcaatatccagatcaagtgactggttgtttctcttacctgtttcgcagaagttattgcattctttgttgaatatcacaaactgttaatatgttaatcttaaaacatgtgaaatatatataatatctatcattacaactacaattccaaatatttatatataacgtcagccatgccaatggacatgcaattctaggcccagcaatggacgataaagtaggttaaaagtgggggagaaaaactggttttaaaaaactgtacctgaagaacatatttaatttaaagggaaatcccacaacagctaaattgttcccccagttgggtagagcctgccatgattagctgtaactgcctggaacactctagactcagctgacgaaactccagttgcctggtgagaacagagtgattttgatgacttttgcagaggatcagaaagaggggaaacggattcatttgattcatttgtggtttcctgttttccataaggagatagttacaggattaaatttctcctcccttttccctatgcactcacacctgggtcccaggacagmaggaccaatcgtcaggaaaatacatccatactgcatcccctgatacttcatctcaggttgggcaggagggttagcagaagagttatttccctttgcgaagattaaagggtatctcacttttattttaacaatgtgaagacaactgttgttccttactattaccaatctactacactggattctaatagctctattacattttccatacattctcctggcatggggcataaatgggtgagacagctctggataaatcactgccagcagcagaggcattttctttagggaatgaaggcttccatatagcatttaactaactctctttttggaaacaccccatcacaaatgagtctttcaaactgaagaaattgaaattgatttcttagggtaataattaacctcagaaaataatgatgaaaagttgcttattaattattttttataatatactttgggaatatttcttttttccatgaaagatagagacaaaagtagacacattttacaatcatataaaatgtgattagactcatattttataggagaatgaaactcatttaatttgcaaaatacttaatatgagagggaggtgtccccctacacacacacactcttttcaagactcttaaatagccctttttaaaacaacacaatctctctgttctgttctttatttcttcacacataactgccttggagcttttaatatattattgctatttcaatcccccatggtttttctacttattcaaaaagaaggtatttttcatctgaatagccattgacagcgaactctggtgacatcctcagtcttccttgacaatgggaggaggagttgtcaccaagaaacttgttactatcccaagtaacgagctagcatccctcagataatacaatagagatggactagtgtttttcaaacaatttaaaacacacacacttatgtacacagaaaaacacatgtatacacgtacacgcacacacaaacacacacactttaaaacaccctctttttctttagtcacctgaagagtcgtaaagcataactgcaaactgataaaggtataaattaaatcatataatagatgttgttgcaaatcgtacatgtctgtcagatcaccgagatagaagtcaaaacatgaaaagaccaggaaatacccacaaaagaagatgtaattgatgagactattcaagatcttttattttttccttcttttgctagtggaaaatttttattctgcacttttctggcggagggtggtattttgttttctgtaagatacaaacaaaagacagttgtgtaaaattaagttatgagaacaacatagaactgtttcttgaagcattccaaagataagtttttgctaattaattaacaaattcaagctggttaaataaaaccttcttccaacacctcctatttaattgcagtttggcaccaacaaatatatatcaaaattatagtatttcccctgacaggaagctccttccttccacacactattatggctctctgcagagtaagccagaattgctgacaaccttgaacactgctacaacaatattactatacttggcagagaagtacccttgcggcaagagaaaagctgtaattttgactgtcacttcacattacactagatattatttcactgtatacacatacacacactcacaaactcttaatagactacagttttcgcactgcctgcctttccaatataaatggcaatataataccagcaaaccgccaatgagatcctggagagaaacaaatgtttggcattatggaaacatcatcagaggatgcattttaagggatatttcattgctttgtcccccactcacaccgttcacaccccatcatcaacttcataagatcatcaccttggttatcaaaaagaaattcactttttttaaccccatggtgggccaagtcagcattaacaaattccatgtttaaaaatttccatggtgttagcaaagggttgtgctatgactcgtaatattttggacattcttcaaatctgatgcctgttatgtaaaatttccagatttcacaaatgtatcctttttcctgcatttatctcgctttccttcacacccggggggagtttgttaaactgcagtgaccactggcagagtcccaagccaagccaaaccgtgcaaacatgaaacggccccacaaatcatgcaaaccctacacgctgtccctgccagagagcagcgcctgtctttgcagagaactaaatgcaacatatgcttccttcttaccaagctcacactgaagcagattgggccaggttccccactgtgccctcccccaccccctgcccagctttgatttacaagatgctatgttaatattccctctatttgtcccaggcaaggaattctgtgatgtcggtatgagctccaaattgagaactccctggaatccggagcacaggtcagaaggatgaatacacagagggagaaaactgcaacttccctcaaggagagaatgctagaaatggcaatgggcaggaaagaaaggatcctkacatcattttatagagagtcgttcatcccttacacaaacctggccaaaaatctacagaatgctgaggaaacacggctattcaacaagaaaatcggagcttctctctctacttaatctctgccatccccctttttttcctcccctttcaaattgctacttcaaacgatttaaataagatttaaacttgttttactgaatcaaggaaaagcaacagcaaactctttgccctctgttaagagaatgtatccaaaacttcaccgggtctgctgaccacaccgaatttaacaaggttcgcaaatgaactagagtaagtttcccacagtgacacattaataataagttccttatcccatccatcccaagccatgaatatgtaatgttataaaatgagtccttttcacacaacggaatctcagacgtgaataaataaaaactatccatcacaagcctgtgaaaaattaatgagagttcggagatgcaaagaaaaatggggacaaggagagatggcccagttcataaaagcctccctaaaactttcagacattaaatatcctagcccccgtccctcaccaaattgccaggtgtgggtggaaagcaacagattttatttttaatgggctaaaattttacartcttaaagcacaattcatgcaagcaactgagagatcacagctacaaacactggactttctattttctccatgcgatcccaatttcagctgcagagccagagtttatttctttaattattcataattcataaccaacctacttccagaaggatttgaggttgctcacagcagttatgagaaaagggagaagagtggggctcgcgcagggctcaaacatcaggagactggaaaaactctgctttgtgcattgttccttgacatcgctgtggacacacagtgcctgattaaattgtatgtgtcgcttgggttataattattatcattgtcaaaaccacttgctggatgctcactctctgcccagcattacactagtgctatgccctgcataaactctgattctcaccctctatgaccccatttgacaaacagggaaactgaggctgggaggagctaactaacctaccccaagtctaagagctggtgagagtaagagccaaaggaaggaggttagccagctccaaatcacctgtgcttcccacctggggccactcactaccactcatgagttaaggtgtatgaaaacggctttggtaacctccttcttgccatcatgaaactgcagcacgctaatactgtcagtctgtctcagaaacccctgccagccagaaggcttaactttgagatgaatgcaaagcagaatgaagcccaggaactttgggggtctgggctaaggctgatgctgggcagcagattagaggcagagcagagcccagaagtccagcctcccctcccagtgcactcctcgacaagaggctgcacttcctcgtcggaaggactccaggtcccactttgggaccagacatgctgcaaaaacaaagaaattcacccaaactggtttgccctttactggattttttctgagactgaaagtgttgccttaagggacaaataccaaaaggaagatttaaaaatggaccaatggggacaatctgcttaatctggcccaacctcctccctcctcccttctccaccatccattccatgtgggcagaacacgtgactcatgggattactgggagcctgccatgctgttctgttttcaactcactacttttgtctgcgctattctttcattcaggataccgccccaacctctccacctggctaaatcactcatcctttgagatgcagaagccaaagagatcctcagcacatacctccagaaagccagttactgcaggggatgcgtacggaccagccaggtaatgtcaatttggaaagcgggccaggtataaattaataggggctggttggtgtgagctgacccggtgggcacaagccccatcatccaactggggcggccaccgtacagggtgagtcaagggctgcgcccgggaaatgtgggagcaaaggtgccagaccttccagttttttaagagaaaccaagaatccaggtttttatgcgaactttaaaaaaagrggatgtgggggtgggggcagcaaacacatgcctgcaggctgaattcaccacccccctccacgttttagatcttataattacatcttctctttaggatccttaaagcataaaggcaagagccaagtctcagtaaactctgcatgggccacagctcggaaaagaaaaaaacctgttatatcgtgggagctcagtgcttgctgaactgaactgattcacatcatgacttgggattcatgaaccagaagcacaggaaattaataaaaactgaaaacgagccaaagagaagggaaaggctctcttaccactgttgagaatgttatgtttaatccctgcaagcagtagagactcagtgtacttccatgaagtgctgcttgggcattcatgaggcattaagggagaaagaatttttaaaatctttgtcttctcaaaagggaataccacgatggggccatgtctagagcaaggtgtctaaggtgattctagggccctcgcccaagaaacgaaagcagcattgaacatgtccaggaaggatgtgaagcctgaagccaatgcagaagacaaagctagataacccctgtctctaagacatagggacttagaactcttaccctgatgagcaacattgaacattggatgtgttcaccagaatggaaggagacacactcctgccgaaatcatgaagggcaaactgacccagaaaagggacaggtcaaggaaggtattacctctgcatagttctaggtgtcctgcttaactcattcaggaatttcrggccagagggatatycaacaggaattctaamctgaagagtttagaaaccagtaggagaatcaggatgaattcagaaattactataatatgcattttcaagtgataaatcccatcaaaaacagaaaaagtgcttgaagaactggaaggaacagtgatcattcttgtcagatggaatcttaaaatccagtgggtttcaaaggatgagcaggagctggacatgaagggattggaggatggggactggaaatggggagttcattgcaatcagaaggaagagcaagaaaggaacaaaaagcaagcagtgtttggggagaccaggatgtgattccagtttggccaaaatatagggtatactgggagaatctattgaggttttgggagtgtatttgtttgtagtttgaaaacacctaagcaattttgaagagaagcagactctttaagtcagatgctgggttctccagtccaaatatgccaatataattgtgtctggtcaatgtctatcctgtccatccctcctgagtgccagatctaaatccaggtgccaatggatgacttccacttgggtgccccacaggcgtcatgaattcagtatgactgaaaaggactcctcctatcttcagcgatggttccactacacaatacactgtccaagccagaagtcccaaactagccttctgtccttccttctccattcaccacgcctgtcatccccttcagagctgttggccaaatcttgttgattttaccaagtatctatcaaaatgtttcctcttcctccctgtactcactgcaatcacttttgctcaagggctcatcatttcgtgcctgggtgactagagttgtttcccagcaggtctccccaccctcctttctcacatggctgccagaacggtcttctgaaaggcaaatctgaccattcgacaactctgctctaaattcctcctatggatccccatggcttggatttaataaatgtttattgagtgaatgagttctctgcatacatgttgttctctgcctggtaccgtggaggtcaggctcgcacagaagcatacttatggtcagagttagtcaataaaaaaagtgatctattctgagttccataccaccccaaaacactgatcagcttggggaaacttagaaagttcaaccacctggggataaagtttggamaactaggctagggccaattcagggtacaggtggaggctaggaagtttggcataggatatcattaaaggtcttctaaggatgaaggcaattggagctacactataggaaggcacagcaggcggagaacagacttgagaaggatttgggaggtgaagaaacagctaaaagactctatctctgacaaagatataatgcccagaattagaagagtggaaatgaaggaatgatgaatgaaagagattatcaagaagaaacaaacaaacaaataaacaaacaaaaatccctgtaatcagtaaccatctattattatgtcccagattttggaaatgagaccctaatgacaagcactcctaaaccttcaacatagctgctgttaaggatgttgtcttgtgggggtgaaaggcagaccaaaatgatactaccaccctactccttaccgatgagtcctttctgattttaagcaaatggcatacagtgtggtgaattaaaaacagcattatcctgattttattactagtatcattactattagcattattgctactgctgttataggtaaaaatgggaacgttgtgaacatttcccattgcctatccaaggtgcttggtactttacatgatatctcacttaatcatcagaaagtttggagttattctataggtaatgagggagatgctattattacctgctgtggtggaataaagatggctgcaaattctttgtcacttctaccagaagaaagtgaggtgtatgtctgctccccttgaatctgagtgggttttgtaactgcttagtccacagcagtcatgctgtgccaacccctaagccaggccataagaaactggcagcttcctgttactttcttttggaatcctctgggagccctgagccaccatgtaagaaatctgatggccctatatctgccatgcaggaaaggccatgtgtagggctctgggyaagagtccctcagctgagccaagcatcccagtcatcctcgtgaaagtgccagacccatgggtgaccatcctggaccagctgaagtgccagtccaattcatcctccagcatagcaccactgactgaccccagtcaacaccacaaggggcagaagagtcactccactgagcccyaacttasagaaatcacaagataaaacaaaatggttgttgttttaagcctctaagttttggggtaatgtattatgcggctatacataaattggaacatccacgttttacagatgagctacttgttactccaaaagtttggctgacttatctgtagtctcctggctgatgaggtgtgcagcctggattagaacctccatctgcctgacctggctgcacacaatgcttgttaagttatcccggaaaacrtaaggccatacaggtgtggcagactaattaaattcaccatgctctttgggctgtgtgactgctaccaaaatgtcctaccctacctcacatattcccttgttaggtagagaaggctggacgatgctacaactgcttctccgccaggcctcccaacgccctcgctgggcagagtcccatgtgactgttttcactgctagaaaaattaacttgcataatgaccaggaagtaaagataaactcaaggatgagagaaaacctcccacctcagaggctccacctcactggggtgaacaagcactgaccttctatcatcctataaggaaaacaagaagaagagatgtttacttgaattactacataggctccctgcctacatccacatcttgaaaattctgagctgtgaagctcttgtggttggctcctgggaacttgagattcccagtgatattccaatgctgaaacagcccagcaaggtgatgcaggtaagcacgcttgtaggatgtaacaatgtgaaacctcagcacattgtggttatgtttcaaagcacgaggtgacggaagcaagagcgagtttacatgggcttgtgatttcctttgacaagatacacgcactcattccttcaacctaagcaaaatttccaggactacaacagatttgaaactcaggtggacgaaaaaaaccatctgtgaatgggataacatacgaaatcatcaaaggtaattgttttaaaaacgtgactcaagatggcacagaacagcgtccacagatgtattcttggttacttaaaaacacaatttaaagtaattagcttaatgttgatgtaattctaragatcgataaataaacctaaaaatcttaatttgatattgaatcgccccaaattaaacaacatattttcaaaccactaaatattgattcatttgtaagatgaggcctttcaatgcaactatttgacctgaacgcaaacaggaaagggttgacacattttctctgtgaagggccagatagttaagtaccttcatcttcgggccacgtatcgtctctggcacacagccttctttggattttttgttcatttttgttttttttaacgggtcataaataaaaggctactggctggagttagcctttgggccataattggttcattcctaccttttcataatctcagttattgatcaggtgatttttcaaactgtgaagggtctacacgttcamcctcttccttgtaagttaatgagttagctaccaagttttgaggaagctagcagaaaacaggagacccaggatcagatayagaggacttcgttactcatggcasagcaaacagcatgagctttatttctgcactgattcccattgccctggcccctagtcmcacagggaggatgtggaacagcccggtagatgccgtgctcatrgtacgtttcagtcatggctgargagccccaagcttasaaaccccaacctttatcaagcaaatctgccaaaccgttgtcctggaaggaggcactgtctttattatactggaaagaaagccatcctgtcctctgctcctgagggagacactatctgtaccttgcaagtttctttgctagacaacgttccttggaaagatggcctgaaaccaaagctgccagcacttctgttcccaagacatgtgaaaacacaagagacccgaggatcactgtgtccaaccaatgacagctaggagaaaatgcaaaaactagcattaccttaatcacaggggtctttttctatgaaccaatcaagcagatttatgtatttttttcagtgccgtaaaaaaaatttgatgattttgaggcttaacatcaaataccagtgagatcamaagttagatatgacatcatacacatcatttctgctgaaaaagtacctttagttaaaaacagaaaccaatttgtaaatgtgaattaaatgcatactccacaaaaaaatacctggtgaaagtaaaaaaaaaaaaaaaaaaaaaaaaacttccttatgtatagatatgtttcctgacagatgtaaatgaaaactaatacggtgacatttttcaaattagccactggaaaactgtgtgtgtgtgttttcaaacagcccgagcaattttcagttatgtcggcctcggaaagtatttatgaaaaggataataaataattaattctactggccagaagctgcaactcctttctgcttcgacaatatacattgaaatgctgtttaaattagaggagcaaattgattcaaaaggcttccattagtgagctggcaaacaggtttgaagttggctaataaattttagataaagatagagcttttgatgaggatggcaatgccggactgctgatctccgagtcaccagtttgttaaatcggtggctgaagtcttgatttcgctccctgtgtcataactcactgtgttaaacaatatgtcacagggcagcacgagcacagtcaaaccagaatggctgctgcaggagccatcagcatgactgtgtggcagctgctcacagagcagggactaacatgggaaccagrctagcttttgcgtccctttctgagtctccagtctatccgggtttgcagaacattaatcaaggttaattaggcccacctgtgacataaaaatttctacctatgctatgtcttgcagcataaagtcacgtctgacatatctattaagaaagattcttaatcaaaatcaagaaactacgcatgaagctcttaattccacttggatatacatactttagctggcttcaagctgctcctctgggttgtggaatattacacagctctgtaaaggaatgatttaaagctgtacatactagcctgaaagggcacacactgtacactacctggggatggtggagtatgtgtccacttatttcagaaaatgagaacaaaatcttatatatgtgtacatctatattaacatgaaggaggatgtacaagaagtacaaaatactaatcatggttgcctcagagggatagaattagatgaaggaatagaaagggtttttttaatgcctcctttagacagctctataattttaaaaaattattcaaataatgtataataatgttcttttataattaaaaaaatctaaaaccaagaaataaacaacatgaaggcttatgtgacttgcagaaaattataaaatggggaagtcatttatttgcttagcttatttctacctggccagtttggggaagcctgtggagaactgatcaatctgtctttctgtccatccactcttccacgtatttaaccaagaaaccagacctaggaaatggtgggtgaagagtaaacagctttagaatccaccaggcctggagagaaattctgcctctacccacttgcaacctatgcagctttggaccatgctctcgatgtcttccaagaataaaataattgtaagagctacagcaaatgcaggtagtgactctacaatttcatccacaaaggttagctcttttcctgtgcacaccaggatctcagtatggctaccctgagcagaataatctacacttggccaagatggcaacccaggatgataaaagcaaaacacattgcagagatctgattattaaggaattcaaatttacactttctcaaatttgtactacttaccaatggggaaaaatagaatgctactttttttttaaggaatactatattttcccttttatttgtagccacttttcaaatggagcctttgtgaagtacttccagccttggtcccaccatgggaaaggtggaattcatagaggaaaatcgtggagcaagccagacacggcggctcacgcctgtaatcctagcactttgggatgacaaggcaggcagatcgcttgagtcaaggggttcgagatgagcctgggcaacatggcaaaaccctgtctctactaaaagtacaaaaacttagccaggcgtgggggcacgcacctatagtcccagctactcaggaggctgaggtgggaggatcacttgagcctggaaagtcaaggctgcagtgacttgagattgcaccatggcactcctgggaggctgaagaaggagaatcacttgaacccggcaggcagagatgagcctgggcaatgagagtgagaccctgcctcacaatcaatcaatcaatcaatcaatcaatcaggtggaacagatactatccctcactacaagtggacaagtggatctgaagcagtgtagggagcaggatgaggacctcacaggcaggtctcttaaaagacagtgtcagatgtcctgcagctcatgtctcaggcttggtttccatgcctggatttcgctgccaaggactgagccttcctcaggggctcattcccctcgagtcctgggctgaccccagcaagagggaaggacagatacaatgcattccaatcagatggccttcctttaagaacactcatgaaagctactgacactttacactgactttcacattttaatagactacaaaataaaatatccaaattgtgcaaatgcagaaaatgaagcgaaaagtcagagtgattcatttttatttcttaattataaaacaagaaaacatgcaattaatatccgtgtgaccacattaagcactccacacataaatgaagcagaaagaacaactaaaaagtatttctcccctttcttagatacaaaaattacgtgtgtgtgggtacatgtgtgtatgtgtctatgtgtattagttcattttcacactgttgaaaaagacatacccaagacatggaagaaaaagagatttaattggacttacagttccacatggctgaggaggcctcagaatcatggcaggaggcaaaggcacttcttacatgctggtggcaagagaaaatgaggaagaagcaaaagcaaaaccctctgataaacccatcagatcttgtgagacttattcactatcatgagaatagcatgggaaagactggggcccatgattcagttacctcaccttgggtccctcccacaacacatgggaattctgggagatgcaattcaagttgagatttggatggggacacagccaaaccatatcactatgagagagagggggagagagggagacagagagagagagagagagagaatagaagaatagaacttgcatttatcaagcacttattacataggaggcgatgttggaagcgatgagtttagctaagttaacttggttcattccatacaacccaaggtagtggatactcattatttcttccatttgatgaggaatctgaggttgagaaaaataaaaaagctcacctacatccctacaggtagtcagcacagagccaagactagactcaagcaggctagttccagagagtcttatggtcaccctatgctatcctgccttcagagggaagggacaaataagaagaacaaaggcagacgtggagatgatagtaggggttgccaagctttctggaaaggagcagagagtattttaggctttatgggccatayagtctccatcccaactactcaactttgctggcatagtgcaaaagtagccacagatagcttataaatgaaggtgtgtagggctgtgttccaataaaactacttcagatctctctggaayttcaataaaagtttttaaaatttagttatgaacactgaaatttgaatttcatacaatttttacatgtaataaaacattattctattggttttttcccccaaacaattacaaatgtaaaaaccattcttagctctcgggctgtacaaaaacatgacaggccacatctgaccttcaaaccacagtgtgtagacccttcatatcagagacagtttgatgcaggggaaattgtttcacctttagtgtgagacaggtctggtgttcagcccatgctctgcccctgtgaaagagctctgcaaccctgggcaagttcttcaacagctctacacctcaattcccacatctgtaaaatagggattaacacccacttcatcaatgtgttttgaggattaaatgaaactggatgtatattaggccaagcattgtactggatacaggatagacaatttattaaggagtctatttacttgacaaataacttactgagtcctgttctgtgctagaaactattttaggatgaagacacagctgtgaaaaaaaaaagctgatacaactttgtgccctcatggagctgacaaaaaaagatattcgtgttttttgttgtttttttttttttgacatggagtttcgctcttgttgcccaggctggagtgcaacagcacaatctcagctgactgcaacctccgcctcccagactcaagcaattctcctgcctcagcctcccaagtagcttgggattacaggcatgcaccaccacgcccggctaattttgtatttttagtagagacggggtttctccatgttggtcaggctggtctcgaactcctgacctcatgatccacctgcctcagcctcccaaagtgctgggattacaggcgtgtgccaccacgcctgcccgttccaagatatttctaaatatgaaagcaacccaacttttcatcatgattcttagtccatccaggctgctataacaacatacattcaacagaaattaatttcttggctgggtgaggtggcttatgcctgtaattccagcattttgggaggccaaggtgggcctcagggtcaggagttcaagaccagcctggcctacatgatgaaaccccgtttctaccaaaaatacaaaaattagctaggcatggtgccatgcacctgtaatcccagcaacttgggaggctgaagaaggagaatcacttgaacccggcaggcagaggttggagtgagctgagatcgtgccactgcactccaacctggacgacggagtgagatttctgtctgaaaaaaaaaaaaaaaagaaagaaagaaagaaagggcaagggcaagggaggggaggggaggaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaaggaaaggagaaaaagaaaaagaaaggaaagaaacaaagatactgactgatttcttacagttctagaggctgggaagtccaagatcatggcaccagcagatctggcgtctaatgagggctccatctctacttcctgtatgtgctttcttgctgtgtcctcacatggcagaaggcagcaaacaagttcccatgcgcccgttttgtgaatgtaggggttatcaacaaacattgcagccataccacatgtatagaccctgcccgttgaagaatgagtcaagaaattgggtgggtgttctgtcatcgatcaactcttgcttatcacccctctgcagtgctgcatggaggtctctcatatacgtgatggaagtgatttgtgctttcagctgagagtagcactgtatccattccaaagtttcagttagcctcagtccctgatgatctgcaggaatttctccttctctcttaaaaaagaaggaacatgatatgccacttgcaagattaggatattytgtttaaaaagaggggataatttaagcagggctggcggtgggrgcggggagacaatggaaaaggctgacatctcctgagcatggctcaagaaggcataattcttccgcatgtataagaataaaacctcttaactcatctcccaacacactgatgtggtggcccaaagtaggctttcaggacagtcaccaggagaaatgttatcttgtgggctataactcaccttctcccaagtgggtccctggggccctctgtggtgatgagcaaattcatgccaaatgtcacttcgtaatgaccaagactcaagaagtgatcaccgttacaatattcagatacacttagggcaggtggccagaaacaaaccatccagagataaatgaacattttgcgctccacagcaaaaaaaaaaaaaaaaaaaaaaaaaaaagatttcacagccaaacacatatttctttgttgcattaagggaaaagtcgtgagatggcaagcaggctgtatttttaaaggatgaaatacagcaaggctgcttccacactggccagcctgagaagcacactggtgaatccatcccaaggcagagacttctagagcctgagagttggcttcattggaggcaggtgtactggggaaaactgatatcctttctacttactccaggtaagtggcagataaatctctgggaagttctggctcaggcattcttctcatcagtaattacaaacctaaaaattacgatctacatttgagtggaacaaaatggactggtggcacttctttcttttctttctctctctctctctctgttgacagccccatcacaaagtctctgcaaagctatgataacctcacggtaagtaacaaatcaactgcagccagcaagggttgattaagaggcgtttcatcactgcatggtgttaatgagcatttgctgttcttacctgtcctgcacttatatccccttctccccattcacctttgggcaacccctcttctctgtgcacttcaggggagccggaccccacatcctgaattaaggggtgagcacatggccctggatggaccaatcggagatggcctcatgactcaggtctgtccaatatgcatgaagccctgggcactgattggaactttgaggaaagagaatcactgttgtcctggtcttgctgagaggacacagtgtatttatttctttgagaggaagtctcgctctgaagtgcagaggtgcaatcttggctcactgcaacctccatctcctgggttcaagtgattctcctgcctcagcctctcgagtagctgagattacaggcacgcaccatgtttcccccagcttctggcttgctacactatggaatggaagacggatgcccaagaagaccaatgtaaggaaagcagagccaagggatggagacagagcatgccctgaaaaaataaggcaagcccatgagagttgagcagggctaaaaactgttttgtctctccttgttgtttgatagtgtttcaaagccctcagggaatgctgcaaatagcttctcaggctatgagaatttcagctcctacttttatgatcaacagagtaagggcatctaagaatgactttttctcaggctgtcacctccccacagcccagatgggcctatatttaaagatccgagtcttagcagtccaggggctatctgtcatcacagaccatctgtgggaccttaggtagggcaggtctgtaagtctaaatatcccctcctcctgagttcctgtcctgtcccctttgcctgaccttctccaactgttctcattagattatacttcatggaaaggggcatatatgccttatatgctggatggtaagctggggacaggggcctgtcatctctggtgtccacaggaagtcaactgaatggctgcatctgcccccattatcatctctgaaacctcagcataaggactagggtttgccatatagctggttctgaataaaatttactgaataaataaattaataaagagattgctccaaacagactgaaggtcccttgagagcaaatgtagacttctgtaaatctgatcttctaacaggaagatcagaatagcagaatactttgtatctaccagagattctctgtatctaacagaatgctctgtatctaacagagatacactgtatctaacagagaccgaaatatatttgttgaatgaagacagatgccccattagcagtaaaaagtaattttaaatccacttacaaccaactggtactatttgtaattcaccctggataggaggatgtatatttccctctttccttcttttttttttttttttttttttttttttgacagagtttcattcactctttttgcccaggctggagcagagcgcaatggcatgctctcaactcactgcaacctccgcttcccaggttcaagcgattctttcttgctttcttaaagccctactcagatataatgaggccttggcctgtactaggtcttccaatttgcattattgatctaaaatttaacttacacagtcaatttcttaatgcaagttatcagaattggtggagaaaaatgtgaattacaactgtgattcgagaacccaccacattataactatatatatatatatatatatatatatatatatatatatatatagatacatagatagatagatagacagacacacacacacacatggcaaatgggcccacatacaacatgttttagaaattgtgatattgcaagtggagcctcacgctgagatctgagattgttcttccatagtctccctgattcccaaacacgtagttgcaatcagactttttttcctaaggttaaaaggacaaatgcttgcaggtatatatgcaaaaatacatacacagtcaatcacagatgaaatacaaaactaaaaaaaaatctgcagaagagaaatggaatttgagtggctttctttttagtcttttctttttatacagctatgataccttttacaaaatatttatttatttatttatttatttatttttagagacagggtcttgctctgtcgcctaggctagaatgcagtggtgcaatcatagcttaccatacattaaaagtatcctcttacctaattttatatgtatgtatgtatgtatgtatgtatgtatgtatstatctatctatctaccttaccayacattaaaatcttacatttctacacgtgcaggactagaatgaacacacataaagcatgataccaatctgcttttttggccaccatataaacattctatgctaaaatgtcaagttgtttcattttacttaaaaaatgtgaatgtgaaatgatttaaacattcaaaaaaaaacttcgaatatcaataatttcacttaaagcttcacatcatatttgattaaaaccaaatatttatgaatcaataaaaatttcatactttcattattacttgtaatttatatttaaattttaatcaataacttttttttttttttttttttgagatggagtcttactctgtttcccaagctggagtgcagtggtgtgatctcgrctcactgcaacctccacctcccgggttcgagtgattctcctgcctcagcctccccaatagctgggattacaggcacgccaccacacccagctaatttttgtatgtttgstacagacggggtttcaccatgttgcccaggctaggttcaaactcctgacctcaagtgatccacctgcctcagcctcccaaagggcagagataactaatttttttttttagatggagtatagctttgtcacccaggctggagtgcagtggtgcaatctcggctcactgcaacctccacctcccaggttcaagtgattactcctgcctcagcctcccaagtaggtgggattacaggcacctgccaccatgcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggaaatgtgcaattaatggagccatgtctccggaaataaaatatttttaattatagggagaatattttaataaatgagcagctcagcaagtcataattgtcacacaattaacagattttcctacatcatacttacatacagtatgagctgcatttaaatatagttgtttttctgggaaacaaagtttgtgagattttatatatatagtctctgatgttttttaggagaaataaaaaaatattggaaacatactcagttcctgtttctagaaagaaaagaaaatcctatgcaagagagtggctatttgtcccacgtcacataaatgagatagtaccagaatctaagtcttagaaggctaagagttttgaaagttatcaaatcacttttccattcaaagcagcagagcatgagtgataatcgtttcaaatccttccaaaagaataaagaatctgggatctaatttttcttttttttaagcctcccaatgcagaaggaatggagatggaaaaaaccgctgcggtagacatcagattccattccttggttttaattgcgtggttgcagtggggaatgaggagagtaaacagcagtgcctcccacggagctccctgcaggttctccttgtaggagtgagattttgctggtgatttatattgtttgagasatacccaaagagtcttgtgtcactcaatccccagctccatccctggctcggaggagcctgcaccgcctcacgggagcctgtaactgtcaaatggcattccccgaatccatcaatactgtttgctgccaaataaataccctgctgctctacaggttgcaaatatttcaatcattgtgcagatctgcacaaacttggaaagaaaactcatgcaatctcawggccttatttccccttcctacataagagaaacatacatgcctaaaccttcactttccaaatgtttactagaagattagaaaaacaacagatgacaggcaatgtgtcagcctagaagaatcacaaaaatccttctttaaacaatctagtagccagatgaagaccccacgccacgagcctgtatgtggttaagaagttcatggggcgaccccattccttctgattgctgcgaaatgtaaaagacacggcctcaagtccaaagcctaatgtgccattaagagtagactgccttggcctcacctgaagcaaatgcatctagacctgtctgactctttgactcacagtgcaggagattagggattccctgtatggttgttcagtctgtacactgaacaactcagttggtcaacatttacatagactacgaaatgatagagacttctacaggtatgcaatcacagatgacagcttgtgtgattctaaaggggggcgtctgaggcaatctactaccattcaccaatgttctgctctactctctgttcatgtttctgtacatcaaccattcattcagtcattcaacaagtattcactaaatgcaaatgaaatgtcagtctcatccaatccttcaaccaccttatttggcagacactattcttcccattagtcccatttagcaaaggacagtttgctaatgaccctctcctggcctcagttaattgaggccaggagagggtcattacattgcctaggagggtcacaaagctctgtcctccaagtctgagtccagtacatttctctcctggactgagctacccagtttattggagcaaaaatttcctttctcaccaatgaatttaagagtcaagttctcaagagaagctggaaggtagggtcagagagattacagtgagaagtgaagcggtagaggccagtaggtttagaaaccagtgctgtgggctgacagggrgtgacaatttccagctttggttctcctcatttaggagagacatgaagtctcatggtgtggtagacaggccacacaagactggaagtctgaagtgtgctcacttcatggagtaaatgtgtagccttgaatgagttacttttttttttttttttttttttttgagatggagtcttgctctgtcgcccaggatggagtacaatggtgcagtctaggctcactgcaacctctgcctcccrggttcgagtgattctcctgcctcagcctcctgagcagctgggactacaggcacatgccaccatgcccgactaatttatgtatttttaatagagatggggtttcaccatgttggccaggctggtctcaaaccccttaccttgtgatccacctacctcagcctctcaaagtgctgagattatgagattacaggcgcgagccactgtgcctggtcgtgatttactcctttctttgaactttaagttcttcatcaataaaatgagaataataagacctcataaagctactgggaggagtacatggatttataagaactagaaaaatgtctggctattgtggatgttcaataaatgatgggtattattattattgactgttcttgggatgtgttctacttgggtgtgtctctggcatctcaagtgtacgtattttcctaagtggggtgtgtgtgtgaaggaagaagatgcccttcttttgtgcctcgccttccccaaaagacatcaggagagtaaacatgccccctatagtgccaagagagaaaaatgtaaattcttttggataaattagcttttgcagctacctctctctttgctatgacttctgtttctcctctgcttaagcaacaaagagagaagtaaccgcaaacgctaatttatccagcggaatttacatttctctttctcggcaatatagtttcttagtgtcttccamgtttttaaatcctttaggtttattcattatgttcctttttcctgcttctaaaaggtagctgttcttgcccactgttttggaagtaagaaaacctaggagctgttctgtaagctcataaacatagtgtgccagaaactgactagaaggacagcagggggacgggggatctgaatgtgccaagacagttatacccttatgggttatggcaaacattaaatggtctagaaaatcagaggccttggaaaagacttgtaaaaataacaatgtgagaacttagcataaaggccaggaacatgaaaggggaagccatgggtggcacatgttggaaactgtgctggaaacacatcctgaactgctcttgcaaagtgaggcctcttaagcagttcctgcaatcctcctcccagccctccataccaggcagaccaagatgtgctcccagcctctgggcagacagtgggttttcaacaaccctgactggggctgaggtatgagaggtgcatatcagagccccaagagggctcttagaaagggaagttggccagatgtggtggttcacacctgtaatccgagcactttgggaagatgaggcaggcagatcgcttgaacttgcgagttcgagaccagcctgggcaacagagtgaaaccccatctctaccaaaaaatataaaaattagccaggcatggtggcagtggcatgcacccgggtgctcaggaggctgtggtcccagctacttgggaggctgaggtggggaggatcacttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgttgttctaaaccgacctttactccttattgccatttgtaatgcatgcataattcaatgctgaagccgagggagaaataaggatgttggtctaagtggccctttttgggttgttttttgatgatttgctataatcctataaataatacaaagcttgtcactgtaaatatgtattgtgttatctagaggtatattcagtggctaaaacaataaaagctcgtctacgtctcctggcaatctcaaggcataattaatcgctggtaagatgtattctagaacgtgagagcccttaagtagaaggaaaaataaaggccattgtcaacacaaatgctaaaagaaatgcctaacgggcatagtcatttgccatctgggaaaagtgtttgctagtgtacttgtttggaaggcaagaaggatgattcaaaagggatttttgttcaggtggtgaagaagtgtgtgtgtctgtatgtatatacatacccacgtagtttttaataaattataaatcaagatgtttaccaagctaacttgtcaattttaactcatttctgttatttgtttacacacacctccatctgacaaatatatacaaaacaatgtatgtgtatgcacatatacatacatatgattttttttaaataaagcataaatcaggaggtgctcagagctagcttctgtccattctaacccatctgctatttgttcacttgcacacactcactgtgcaataaaccctttcaatgtgggagacaagtgcaagatgcccctctttccccaaagggcacctctgtgtgctccctcagatcatagctgatgacatgtcaatgaaacggtgcttgctctcatcccagagatcaaaatgagggcttaacctgcaatttactttacaagtcccatgacacttgccagatctgaagacttcattctaatcttccctgttgaaaaaataatcaaatactccaacaaagatgtattgacaactcttaattaaccatgctaatggagggaagagatagcatggataaatgaaatccacacataacccaaaaccttccttccccattaatttccaacttcttgactaaaccttactgagataagtgggtggggagtagggagaggctgactaatcctttaacgatagaattacttgatgtctacatctgtactatgccaatcagctgttggacaaggtaacaagcaaggaagtggccaaggacaccatgtgttcccaaagcatcggggttcagcggtaatgtttttgaatcttctcgggtgtaagtaaatatatttcagacagcttttagaatgaagttagctagaagarttttgcagcaatagaagctgatttgatgtagaccttcaggtttcttatctatttattggtgctgctcagttggatgggaaagagaggagaagctgagagacgcctggcacctgtacagagtgaaacaggcaatgctgtgtaacgagcagttgacagcaatgaataagggttgcagaaatggcaaaagagggcaccaaattaaccaaagcctagggaagatgacgaagccagagtattcattaagggaccagatgaactagcatttattgagcaccttctgtttgccagggcatataagaacatactgtgatgaggcaccatgaaatacgacctttgaacagaaactgggtaaaaaacaaaagtaggcttcctcctcctcctaacagcatctagtgcagccacattagatgggaagagccagaactaggcaagttattccactccctgatcctcagctgcctcggttgccatctctgcacctgcagggtgaacacaccccaatagcggtaacgtaagcatacccttagaatgatcctgtgtgggagatgcacctgaatgtgtggtccgggctggggaatccaggagtgaccaacccagagatttgtcccttatatataacagacatctgtgccccatgcctgtcccgtggaacacaggccaaacagaggattgaggtcctgagtttggagttaaatgaagattgccaggtagaggttgttagggggagggtgttaagtgaaggtgtgatataaaccacatgacatttgcaggtggttatggttttcctgcccagcccaccgccaccactggactgtagggaggtggatatcctgtccagcctactgccactggaccatttctgtatgtaaggtgggcagttgtactatccagcccgccatcactggactctctcccctatatgtaacctcctaataaaaccccatgtctatctgttggctctgagtgtcttcttcagctcttgaacctggtgcctttcctattgaggttaataggggttcagcatgacagcacctccacctcccatggcacagcatatgtacccaataagcagtccttacaataccaatagtttctatctgttgggcactgccaattagccaggcatgtcaaatggaagatctcacttaatcttgcmaaaaaaaaaatgttgttcgttgttgttccttctattacagaggaaaaaacaaaggcagatggaggttacattatttgcctaaagttacacagctagaaaggagcagagttaagaatcaaaccccggccatccagctccagaaccgagcttgtgaccctggcatgggtatttccggagctctcgctaatgtgccagatagacgttgtgctaaagaaatgatctgtgtgtgttttctcatttaatatccatacagccccctaaattggagattactactgttacacaaatgaggaaactgatcttggagagggccagtcagctgccaaggtcacagagccagggagtgggggtggcttgcccaaggccaggtctgtccctccaggtgaaggtaatgattaagaacacaggtctggagtgggtttgaatcactgtgtgttcagccgctcactggggacctggcctcagccctctgaytactgcagggctttattactttctgagttctctttgctatctcactcgccctttcctcccatttctccttctggtgccccttctccycttccaggcccccagcccccagcccccaccccacagccatctctgtattaaatgtttgtggaatgttcaccgttcaaaagccacgttctagtttgaggctttcaattcttgggaagaaaggggccatataaatacaaaaaatcaagtccgaaatgttgttgaaatgatcattttggtccacctaagtttatacaaaaacattttccatgctctgatctccccacttgcactgttgggtagcccaagttccagatgaacggccttctcacctgcatgctgaaaccagccgaggctgctgccacattaaaaactcagcccaggctgctcctgaaaatgtttctgccctcagagccacgtactaaaaattaaggggattaagggaactctagatttacatttaaaataaaggagaaactcattggagaggctaatgcggcgtgcactggaggtagctactatcactaagcattaagataaacaatacgagtggcattctggyccacgcctggcaaagtgcaggagtccctggaggaaaaggaatgagagtgcatcagcgacctcgtgaggcagtgcagctttgcattaatgcctgcagctctggaggcggacttcctgggttcacattcacaacacctccaccgccaccactccatgagcttgggaaagacatttaaccattccatgccttgtcatctataaaacggggcatgacgccagacacggtggctcacgcctgtaatctcagcactttgggaggtcgaggtgggaggatcacaaggtcaggagatcaagaccagtctggcctggtgaaactccatctctactaaaagtacaaaaaaattagctgggcatggtggcacgtgcctgtagtcccagctgctccggaggctgaggcaggagaatcacctgagcccaggaggtgaagcttgcagtgagccaagatcgtgccagcctggtgatggagcaagactctgcctcaaaaaaaaaaaaaaaaaaaaaggccggggggcataagtacttcctcagagggttgtcctgaggactgaatgatgtcatttaattcacattgatatggtttgaatctgtgtccccaccaaatttcgtgtcaaatttatttatttattttttgaaatggggtctcgctctgttacacaggctggagtacagtggtgcgatctcacctcactgcaacctccacctcccgggttcaagcaattctcctgcctcagcctcctgagtagctgtgactacaggtatgtgccgccacgcctggctacatttttgtattttagtagagatgaggtttcaccgtattgtgcaggatggtctcaaacgactgagctcaagcaatccacctgcctcggcctcccaaagtgctgggattacagagtgtgccaccgcacccagccttcatgtccaaatgtaatccctaacgttggaggtggggcctggtggaaggtgattagatcatgcggacagatttctcatgcatggtttagcacgtatgctgtgtggtgagttggctctcctgagatctggttgttgaaaagtgttttgcacctgcccccttgctccctctcttgctcctgtttgcaccatgtgagatgctttccttcccctttgccttccaccatgattgtaagtttcctgaggcctccccagaagccaagcaggatgctagcatcatgcttcctgtacagcctgtggaactgtgagccaattaaaggtgtcttttaaataaattacccagtctcaggtatttctttatagcagtgcaagaatgaactaatacacacatagaggatggagcactctgcccagctcatgccaacactccatcaatgttagtacttagcatcagcattatgttgcatagctgatgattcatatacacattactccctgcaatcaatgcccaagccttgcaagatatgtgcttcaatccccactttacagagggctatggatcgccaaggctccacctgcagttgggttctacataagtgtcctctttcctcacatcttcagtaaagtatgagacctccatcaatgcctgcttgggtgaggagcacaggtgggtgaaaggtaagggaacaagtggaactccatatccaaggtaggcacagtgtggaccagaagagcatccctaggacagtgaggtgatccacggactgacctgccccaaggccagagacgcaggagtggaaagtcacatggaaccatgagcttttataaggggcagggggcaggtgttgggaaattgcagaactagtgtttgagcagatgcaacagatccgaaggaaatagagattgcagttgaaatctgggtccaactggccctatcagctgcattcatgtgttacctccctggtcagctgtaccctccttcaggattaggactgcatccttaccaatgctgagtcctctgggatccccagaggcatcttttgcacccatggcaaaaaaaagaaaggtgggcagcagcaatgagaaccatgtccactaggtgcaagtaataacgggtgcattgttcgctaaggacttaaaagtattaataaaagtgaccaaagtttaactgctttttatcatcaccatgcttggtgattccaaacaatgtcagtgaaaacagattcctcctgctggcaggggggcggccacacccatcacaccccctcttggcaccgccatgattttacacactgcactcaacaaatattctctgaagggctgaaaaaaagggggctggggaagggcagaaatcctgttgatttctgagcagcaaacacgtaaacataactgacattaagatatacaaaatacatctttcaaggaaagatgtgccattctttcttgtgtgaaataaaaacacctccccatgcaagattccaactgcacagactgatactgctatggtctgactggaaacaggacatcttgcattcttgtggctccgaaaatcactctggggtccaaggatttatttcctctctcgggagtcagggacagataataaatacccctcatcagctgatcaattgctcgcacttccaggcaagcacccakcactccccaccaaacacaccgccccacgccacctgaacraggttaaaagaacggactcatgactgatggtcggggggaactggcttcagaagaggaagttgaaaatattaagaaatcaacacgggcatttaaaagcaaagccttttccatgccacagaagacgttttgctattcatcttgttccctgactctgcttcaccaacttgatggaagatggtttaactgacataaaaaccagctatacatgaacagcggtgattgatggaaccattccaaacatcagccaaaaatggcactgaaagatgccttgggcttcctgttaactgttttatgaggggaccaacaggtttcccccctcttctttaaagaatatattagcagtacaagtactttcaaaaacagggtagtgttataccaagagagaaacagaaggggaaaaaaaaggtaggaggtcttttgcatgttagtatatgtatgaagggagttaggacctggcaaactgggttatatgaggctttttccatacacagctctttggtttcacggtacatgatttaaataggttgtatttaattccatgtaataacaaactgtgccattaagtagttctcctgtacaaatgcaatgtttcaatggcaacagaaagaaaatccagcctttaaaaaatgcacagatgctccaaatgagccatgataaagaaaggggtggggagcgggatgatctgcaaaaaagaatgagggaaggcagatttgtaccacttgtgctaaagcgtggagccttaccattcagggagaatgagacgtttgcaaaatggcatcctagtctttgaatgcttcttaatatggaacggacgagaacagaggtggcaagagggttagaattccccctctttgttctcctttctggaatggagaggaccttttcctgcctttctttgctcttattttgaagaggttaattatgacctggaagcgcccaggcacttgggtctcagctattgtcgaggaagaatattgtctgcgctgtaccgcaagaactaacttaggaaacattcaaatttggaactgctttcagaagcctcaggaccgattccatgtggtggcattctatgggatgacaaatccccactccgttcccactacttgtctttgaagacatgcacattagtgaggcagaaaattcactcgactttaaaataaaataagctggttatttggcccatctagaatacattcgtatctcaacatttcaaatcaaaaggcccacttattcctgtcctcatcctggctctgaagccaagctcaaggtgctctcaattacatggtagatttctggcccaagttaatatgtatcaggacttctcaagcgtttgtacctttgacctagaaattctacttctggcaaatcaatcccatagaaataattttaaatgggaaaaatgctttagaaccaaagatgttcgtggccatggaaatgacgactgaaaagagttagtgacaacctaaaaatacagttagaaggagaatgatgaactaaaccgtggttcctctcattggtttactaacatgtccccattcaaagcactgttcaggaccgtctagaacaacctggaggcatgcttttaaaatgttaagagagaaaagaaactattatccatatgggataattaacaatgtgttaaaaatatacatatctctggaatatttgaattgcaggaggagaattaatttagagataacaagcaaatccatcacgagtacatatgccacaattgtaacaaaacaaaataaaacaaaatggcctgggcatttgaaactactgtaagaatatgtgccaaaatgctaagagtagatatatattggaggattttctttttcaatctttttttcaactttggagtattttcccttttttatgaatatgtccctattgtgtatgagaaatagctaattttaagaagaaacagaactccaagggggaaagaaaacacttttttttgctcctatgagaattcactggataagggctgtacatttcgggcccgcctacttcattccacaggaattagtaactgcaggtgcaagtgttgctactgctcgaaggctaagccctgataaggcctggggaggcccagagactaacaaatgggtttcttccaggactttgctgctgattgatcactgcacttaatcctttccagagatagttactcaaaaggaccaggaaaggtaaatttaccaacgcaggccaacgtgactaaaaatagaaccataaaaatcttggggagatgcaatgtggcaagaccatggtcttcattaaggcagggctgaaggtggaatcctattccagatacttcacagcttagatcttttgccaagcctctcacagtctcaaattccccatcatcagcaggagtcataacagattgcaaggaggtttaaatgaggcaatacatgaaatatgccataaacggcaatttatcagcatctatgatccctaacattaaacactgaccacttccttatgtgccagacacaaagctgagcacttcacatgtactgcttcacatactccgagaattattttatttaacccccatcgggaagagactattatcatctccttatcacccacagggatgctgaggttacgaggtatcaagggacctacccaccattgcacaggcagaamacaggagagccaagactgacacccccagcaggaggtgttccagccaccttggacaccttccaccacaggctgagccgcagtgaagggctttcagaggggcagtccacactggacatcaaacggtagagtggagattgggtcaaggacaggagcttcattatcttaaatgaattaatgcgggaagagaaaaccaactaccacatgttctcatttgtaagtggaaactgagcattgagtacacatgcacataaagaagggaacaataggccaggtgcggtggctcacgcctgtgatctcagcaccttgggaggccgaggcaggcagatcactcgaggtcaggagttcgtgaccagcctggccaacatggagaaacactgcctctacgcaaaatacaaaacttagccgggcatggtggtgcacacctgtagtcccagctactccggaggctgaggcacaagaatcgcttgaacccaggaggtggaggttgcagtgagccaagatggtgccactgcattccagcctggaagacagagtgagactctgtctcaaaaaaagaaggaaacaatagacactggggcctactggagggtagagggtggaaggagggagaggaccgaaaaagcacctattgggtaccatgcttctgacctgggtgacaaaagaatctgtataccaaacccccatgacatgtcatttacctatttaacagccctgcacgagtaccccagaaactaaagttttttaaaaaatgaaaattaataaaaattaaaagaaatcacagatgtttgcatatcacatcagttactgcagatatttcaaaatatcatttacactcaacactactcaaaagtataggtgttagtagatacactattacctcttgtgatttaatgtactatagaagaaacgtgtattactatagaacaataaaaatgttgatatttgtatttcaaaaacaaaacaaaggaataagggcttccaaactttaaaatgcaagagagcatcatgggatgacagtggaagaatggacctgggtgagaggaggctaggatggggagagggaagggaaggctcacatgtctctttttttgtttttggttttttttgagacagtctccctctgttgcccaagctggagtgcagtggtgcgatctcagttcactgcaacctccacctcccaggttcaagcaattctcatgcctcagcctcccaagtagctggaattacaggcgcacaccaccatacccagctaattttgttatttttagtagagatagggtttcaccatgttggcyaggctggtctcgaactcctgacctcaagtgatctgcctgcctcggcctcccaaagtgctaggattacaggcgtgagccactgtgcccggctggctttcatatctcttattctttctgcttccgctctctcctgtcccctattagccatgggttccagagaggagagaaggctcgggagagcaggggactcaggaggtcaccctgctaccctcacctttttaataaccctcctcaaaccctggttccacgtctccctcactcaaggatttatgtctcattttcaatggaatgttacatttggtcagaccacgaagaaaactcctcattatraactaggaaatgtgtggagagagaattatttacccaaggcagtgctcaatcagtgttgcccgaatatttatttagcccacacacggagaagttgtgttaatgtttgccaaagaatgtagctttataaagtaactgggtcaaaaaagacagcatatcattttacaaataactttaaaattgcttaagttaaatagctgggctctctcaggtttgtcttttcaaaaacgctgcagaaacaatatccagaattatgtctaataaaatacaggtattacaaagtggctgtttagcccattaaagaaaatggagagtgaaatctgaattatttctacccgaggcagaagcagacaaagttaccaaaattatgttaggccgacgtcgcaattcttcaagtctgcagggcggcaaggctaacagctcctgcaccaagactctattaggagagctgtatttttcagtcaacaatgacaggcattccatttctcagcctcaaatctagtgtagctatggggaattcacccaaaacatttgcttttgctttatcagtggcatttgtctgcctcaaaagccttgtgagggagagggctactacgtgacgctgccaggcaatgctgttggaggcagctgatttgatggacaagaaggggagcagtgaccacctgggtcactctgactccgccctctctgagccaagtgaatctgagcaatgatgtcataataatcatcaatagcaacagtggctgcgcgtgaggggcgtggtggttcacgcctgtaatcccaacactttgggaagcygaggtgggcagatcatttgagctgaggagttcaagaccagcctggacaacatgctgaaaccccatctctactaaaactacaaagaattagccaggcatggtagcacatgcctgtagtcccagccactcaggagcctaaggcaggagaattgcttgaacttccccagcttcaagaggaagagtctgcagtgagccgagatggcgccactgcactccagcctgggtgacaagagtaaaactccctctcaaaacaaacaaacaaaccaaaaaaacaaatagcaacagcaaccayaatcatcatcaccatcaaggctggaacaaggatgaggcaggcaggctctgatagcaacaggaggaagcagaccaaggagggagagaaaggaaggcagagaaggggaaaaaaaaacacaaatgataataatagatgctgacatttacggagcacttactatgtgctgggaaccatgctgacggcacaccgaatccactgaacaggtgggtaagtatcatgggtcaatatcattctcattttaatgttgacagtcacaagactttcatctgtacaatgggggtactgctggctcccaaggccagtgttggtggaatacagtgaatagaggtgagtaccgtgtgacaggaggctgcatcagtaagcaggggcagccagccaggtgaggaacatgcccactgagatggaggtcaggacgttgagagatccccaaattgcaagttgtcatcctgagacaagcgataccttgctggacactaattcattcttggagtctctccctctcrgccctttggcttcatgttctggagagaatgaccagagagacccatttactcaacgcttctcaatgagacagggatcttctaaagggcactgtcttatatagatccttgcacctgcaatacctgcctggcccagcctggccctcgcaggttcttgtgaaatatttgcttatgagtaagcaaatgcataacacgagacggctgctctggaatgacagttgcgaacacaggaggctgctgagacttccagagactgtagataaagaacaaagaccctgtgaagttcctccgggaaaccagatgtggcagtgtgctagggctgccctagcgtatcagcacaagctcaacagaaactgactctcacagttcaggagaccagaagtctgaaaccaaggtgttggcaggggtgactccttgtggaaaccgtgccaggtttctctcctcgtttctgggggctgcccatgaccgtggcatctcttggcttgtagacgcatcactccaatctctgcctctgacttcacagagccttctcctctgtgtcctctcctcctttttctgttttgtcttttggtgttattttttttttaagagatggggtcttgctatattgcccaggctggcaatgaactcctgggctcaagtgatgccccctccgcagcctcccgagtagctgggattgcaggcacacccaccactgtgccccctgctttcctcttctcatgaggataaccgtcattggatttagggcccactctaaagcctgaatgatttaaccttgagattcttagctaattacatctgcaaagaccctgtttccatataacgttacatctgtgattctgtgtgggtgtggattttggggagacgctattccacccactacccttacactgcaactcacccacactgacagcttcccttgcctgtgtctgtccaactggcttagaaccggagcatggcatcgtcaccatggactttgagaatgtataaagacaggtgcctggtcccattccctgtgagtcttgaggaaaaaagaaaagtgagcttcaaaaactagaagagccagcctggtgtggtggctcacatctataatcccggcattttgggaggttgagactggcggatcacctgaggtcaggagttcgagaccagcctggccaacaagtgaaaccctatctctactaaaaaatacaaaaactagccagacgtggtggcatgtgactgtagacccacctactcaggagactgagacaggagaattgcttgaacccaggaggcggaggttgcagtgagccaagatcgcgctgctgcactccagcctgtatgacaaagcgagaccctgtctcaaaaaaagaaaaaaagctagaagaaccaaatcactaatgcctaagcaagaacagaggggatagaggggcctgggaagcaaggcctgtaagatcccttgacaataacacaccagtcccatgagcaggaacacaaaacattatccctggacccagttctccatcagggtctcagcatgaatgaggctcttccttcctcacggggatgggaggaccaccctgctttctttgcccttcccaggaggaagggaacagcaccttccccatctctgccagcatctgtccatcaagagctggtcaacagcttagactcaggggatgccacagtccacattacagtgtcactgggccagggctgggagaagccgtgggagaaatgcagaatggggaggctgaggcaaagtcaggatgaaccaaaatgtaggtgagcaccagacacagtggccacctgaggaggaaacacacaacagctgagaatccacgggggatgcgtggccaggttagagcatcctggaatcaggcaggtacgaggagtccacgaagtggagaggtgatgcaaatctgcaggccttggggacaagagcacatcaaacccttgggggccgatgccttcagtattcctaattcctccatgttagaaaggtattttgggccaggtactgtaatcccagcactttgggaggccaaggtgggcagatcacctgaggtccggagttcgagaccagcctgaccaaaatggagaagccccatctctactaaaaatacaaaattagccgggtgtggtggcacatgtctgtaatcccagctactcgggaggctgcggcaggagaatcgcttgaacctgggaggtagagatcacggcragccaagatcacaccactgcactccagcctgggcaacaagagcgaaactccatctcaacaacaacaaaaaaagtaatttagcacatatactgcatattacaaaatacctttgcggggtttggggcaacatcctataacaatgacatttctatttcttcagtgaaaatatgattattcagcctggccaacatggtagagaaaccgcatctctacaaagacacaaaaattggctgggtatggtggcacatgcctggagtcccagctacttgggaggctacagcaggaagatcgcctgagcccgggaggtcgaggcttctctgagctgtgaacacactactgcactccagcctgggtgatgaagtgagaccttgcctcaaaaaaacaaacaaaacaaaatgaacattcacactagaaasgagaaacagggacgctaaagctgaagtcaaatttcaccaccaaataaatttgctataaatatacaataaatttgtttttgcttttcagatctctttgggttttggaataacaaaaaagggactgtacatggatatttccaagctggaaccgaggcactttctagacgaaggcagccttatccccaggaggtaaggtgtggaagtgagttgagggttgaggccagcaagactcagaccacagcctcctgctccaaacagccacatcacttaatctattttgtaaaccaggcttccctcaagggatctggtttaatgagagaatttgggagctacaaaaaagactgaaaattgttgttggacatcagatgctggcaaactttttttgtaaagggctaaatagtaaacaacttaggctttgtgagccaagaggcaaaaccgaggctattacagaggtatttacataacaggagagaaaaacaaatttctgcaaattttttattgatgaaattcaaaactttatgacactgaaatcagaattccatatcattttcctccttcaagaaataatattctcctctttattcttttttgcagatgattgaaaatgtaaraactrttctgagcctgcaggccatagccaaagaggtaccggctgtattttgtccatgggcaggagcttgtgactgctggtctaggtcattccaggtcaaccaggggcctctcccagagtgagaaccactggtgattccccagagtgggaccaagtgaaagcacttggctggatcagagggataggagcctggctgctcctaaaacaagacactacttgcctttgatgttcaagtcatttaagaaygcaattgcttcctactcaatttttcaaaaccaaaataacaaatacgatatgagccataacttagcaaaattacgtgttttaaacagtctctttcaaaaaacaatagattaaaaagtgcaatatttttaccccctcttaaattggaatcatggtatagcaggcaggatacaaacttctcatttccrttacacattttcagtgccatcattaatctgaatgayatcaacaaaatgcccaatgcacataaatcagtcagactttgaatcattcctgcagcctctgaacatttaccatggagctcaataagccaggcaagaacacagatttttttttttttttttttttttgagacggagtctcactctgtcacccaggctggagtgcaatggcgtgatctcggctcactgcaacctccgcctcctgggttcaagtgattctcctgcctcagcctcctgagtagctgggattacaggcatgcaccaccacaccggctaayttttgtatttttagtagagatagsgtttcaccatattgatcaaggtggtcttcaactcctgacctcgtgatcctcccatctcggcctcccaaagtgctgggattacaggtgtgagccaccgggcccagccgtaggaacacagatattatcatcatgggacaagtcatccattcycagattccatgaccctctctggtgtccactgtggatttcagcacatgtttaactatgaaactctagtcacgctttttgatatacaggttcatggttactagtgtcttatcctgcttgagccaagaatatgcactaacacattagacaaaccttgaattaaaatgggcaacccaccatccaaatggggaaagatgattacagacaagttcgtacgagtaaactacttgaaggcaattcctgtgcttaaaatggccacgtgaaaggtgtccctgacatggaaaggacaaaccatgaaatgacccttgaagctcttaakgtgtctgtcaaaaaagcaaagccaactgtcaaactgaaaagccaaaatcatcacaaaaacacctattcttcagaggcctcaaatctcaaactatctcccaccatcctttgtaagtatgtataaggaggccaggaaactagcatttgctgagactttattctcagctttgtatgctttgcataaatgatgtcatagaacacattgacagtgagaaaactaacgtattaacattttaattaccttgccctatcacgagattagaaagattcagatatgagacatccaaagtctgtgatctgaacaccagagtcagaggctggcaacctatggcccacgggctgaatctggcccactgcctgttcctataaataaagttttattggaacacatccgtccatttatatattatctgtggctgctttcctgctgtaacaggagagttgagaagttgcaacagagaccataaagcccacaaagctaaaaatattgactatccagccctttagagaaaaaggccatgcccaggctcctgtgggtacctgctatgctacagcccctctgctgggggaaaccagcccactcacaggttcccagtgaggcaggatctctgggcagttccttagtaattggtggctctgtgacttccttcccccaatcaccttgaccatctagtctggacaatatgagcgcccatgacgtgaggacagccttgtaaacagggtggcctggctggaaagccttgtccaaaaggcacaacagtgactacactgaacccatcccatgcatccttttgagagttagaaggaggcaattgcaagccggctgcaaaagaaaaaagacaccagagacttagaaaccagtgaagccacgctgaagatgcagacagagagctagagacaaggtcaggggcctctgttgcactccagacccggtccggaggcttttccatgcttaggggcaaggattgtcagggttctgctgtccctttctttaacctcctttatgattccccaagagcatcctgagtgcacctccactccctgccaccaggggtcagatgagccggcctggcaggcttgtttccctccaccagacaacagcaaggaccaagattggcaaagtgacacatcctctccaaaagaagaacatgcagaacaaatcaaagaacacaaaccacgactgacaaacacagccacactcgattttaaagtactgagctgtttgaagaaaggaagcatggcaaggccccttcctactaataacagtaacaacaataatactaaatattttataataattttaaattcttaattatttatgatatttccctccattaacatcacgaacatcattacgtgtgtgtgtgtatttttctcattttaaaaccagcagatgagagtaaaggatttctttttcctctcccccacctctttacaggacctactgttaagttttcaagaccacccagaaagaaatttgaagttgggtttatatccttaatccctcagttagaaaaaaaagaaaagtgaagaaactgcatctccaagatcctgctatatcaacttcagttttttgaagttaaatttgatttttaaatcccttggctgatgagacctgtgtgggttttttttttgttgtttttttgttttgttttgttttgttttatcattgtacctctattttaaaaatagagacttgtggttctttttccaaaagcagtccaacagaaagtgaatggtggtcaatgcataataaaatgagagttaccttttgacttggaagaattattagcattttgatttgatgggttcttagctcttcaaattcaaaaataccttattcaagtctaggagttttgcaaatacttcggttctaaagattaccctttttcgatgctttgaaaactaaaagggcatatcagaatagaaatctggctgttgaataacttgtaagctctgcagagacgtacaaaaacatggccactttagccagcagtgtggcgaaagtctggggcccacactacacacacacatatgaacttctcatgaccctcaagtatattcacatgatatatcacaaataccataaagcagcattgtaattacagggaggaattgattttaaaaggcctacatcaaaattaatagtcataaaagtataataacctagactggaaaatttagggattagagcattttgaacattatacctcaaatttataaaggctgtatattagcattcacaaaggtttttaaagatggaatagctatgtacacagtgaatttattctaaaatccagactcaaaaaaaaaatgaatatgaactcctccccaccgtgttctggactaaaatcaataagttccctttaggtaattaaaatgctggtcccacgacctgccatcctattcccaggcttagaatgttaggaacactgtttctgctttgagaatggaagagagcaggttaccctgatgcctctggggccaaacacaggggatacattttcccagtagaagaaatcagccctgatcctcaagaagaagaacatattggcatattttagtgagacggaggcatactgcatcttggggtaaaaactgaatcatcaggccaggcacggtggctcacgcctgtaatcctagcactttgggaggccaagacaggcggatcaccaggtcaggagatctagaccatcctggctaacacggtgaaaccccatctctactaaaactacaaaaaaattagccaggtgtagtggcaggcgcctgtagtcccagctactcgggaggctgaggcagaagaatggcatgaacccgggaggcggagcttgcaatgagccgagatcgcgatagtgcactccagcctgggcaaaagagcaagaatccatctcaaaaaaaaaaaaaaaaaatttaatcatcaaaggaaaatgtttcaaattctagggtaagctgacatggtacacatatacagcgaaatacacccagggaggctgaaagtccaataggccaccacagcacgttaaaaatgtcctgttttacctatagtcaacaataataataaattatatatttaaaaatttgttaaaagggtaggtctcatgttaagtgtttttaccacaataaaatatttgtttaatgtcctctacatggctattatgattggaaaaggcataccttgaacagagatgaataaatctgcatatctgtgaaatgtcagttcagcatgttgatcgtcagtaatcttttcagaacatttcagatatatgaaaatagcaccaatgtctgagtttgaacctgaactggtttcagctaaagtgatcatcttcagccaaaataatgggtatttctttcttggccttccttctacagacttctaaaagacagtggaagcactgaatatccttttagaaacaaacaattacaaattagctgggcatggtggcgcacgcctgtagtcccagcaacttgggaggctgaggcaggagaattgcttgaacccgggaggcagagattgcagttagccgaaatagcaccactgcactccagcccggtgacagagcgagactccatcttaaaaaaaaagaaaagaaaagaaaagaaagaaaaagaaaaacagctacagatattcattcctttttaatttcttgataaataatagaccagtaagaatcacataagaagcagtctacatttttcaaagagtttttacagatcccatttgatcttcaaaagggcctccattaggaaaaactaaattcaagtttaaaactatccattttatttctcccataaaaatatattcagcccctggagataatctccaaattcctcagattttaaaagttaatttttcttatcttgacccaaaatctgtagaaacaaggatttttcaccaacagtgagctcccttttcataaaatccttatctaccaagatttacctctgcaaacctctacagtccctggttgtgagcccctgatggaagaagctagcataaagaagttcacaactactggggagggaacgacctgacaagttgcaagcaagaaaggagtgaaaaactgagttaattgtacaagaatttgtgtatttataaatgcaggataaataagatcacgtagaaactctctttagacttccatccttactgctgtaattgaacgaacagacgaatgtgtttgaccgcaattgccctaatactatttttcccataaatacctgaaattcttcaattgtaagttttcctactctggcaattttaaggaaagtgattcttgaggctgtgggtgaaataccacattcattttttttaaaaaaataaggtatacttacttgtactttctaccattttatatatattctctgtttaaattgtgtagcccctaatagactgcaaagacaatgataaaaaggaacttgccttattcacaggtacatccttggaacttagtaaagggcttaacctccatagcaggcagtcaagacttactgaatgattaaataaaaacactgaattccatattgtgcaggaaaaaaaaaatcaagattagacctcagaaaaaattgacatgtctagtagaacttactatctgggcaaacttgaagagaagtgcaatgggaaggcctcctcaaaaaagacattgaaatcaagatgggacccgttcctaccctggatttctctgaatcagctactccttaagttcgtattttgttccactcagccaatggcaattccaggagagaggcaattgataataattatgttttctgccttctcttgggttatgaatttatcatgatgcaaaagtcgagctactccgatgccacgttaacaatgaaaaacaccataaagacaaaaagaaactgaatttaagcatttggattctgcagaggagtttattgaacagattaactaaggaaaggcaaagctacacaattatggaaaacaggtagcaacactcaggctgactattttcgatggccacctgagagcggatttccaatgccctcatttctgtaggtacattatcctgtgttttattgttagtcacagctgcaagttgattaatttgcattcagaaattctaagtggcaaatgtgcaatgcatagtaatatacatttttttatggacactgtgaaaatgccgaagccacatctcataagtaactcttgctcaaccagtgagtaaaatccataaaagagtttgcaaaaggctttgaaagagtttggtttgaaaggaaaactgcaagagcaaatccctctcctccaccccagcccttaaaaaacaaaactaaactaagtctgaagcaaaaccaaacaaagagaacagttgggtgatgtcaagctgccagaatcataaatgttgtcagttcacgtcccagtcttcctgctctcttggcattgccaataaaatccagaaacaccagggatgactcagtaccacagtcagtgcgtaaataagggataaagatacctgttaaatccattgcctcaaagcaatcatgggagtttcttaagaatactgaacctcctctccgttttctgcactaaagagataaggagtggcatggagaatctaaatgtgtggaaaatatatatcattggtgtgagaacacatattgtgataggtgttcccctccatcagccccctagtctatactcctagctgctttatcttccagatcatgcctcccctgctcaaagtgaatttgccttccctttcacactgaccttagaagtggatctgagaccatgcttcctagcaggagaaaacaacttttccatttgaaaacctttgcgaattacccacaactctgacaacaggtgctcagcagttgatagtattctttttggaaagttttatcaaccacttaagttaacttgaagacgcctaacagcaggatatggtcaagcaaacatgttcatcaattaattcaaatgcaattttagtttacttttatatgatttcccatgcttaaaactactaattgctttcccaggctggctgcatgaacatggcccaatcaaaggatgcaacagtcaaatgcttgtgtacatcatgttacctgtccatttccatcagagacatcatggacacagctgaaatactaggcctggccttttgtaagttcattagagcatcacaaacataactgcagctattctcactgtttgtgactctgtgattcaaatgttttcacaaaccttccctggcactgcgtattagatggattgaaagatgctgaaacgtaaggccgggcacggtagctcacgcctgtaatcccaacactttgggaggccgaggtgggaggattgctagagcccaggagatcgagaccagcctaggcaacatggtaaaaccccatctctacaaaaaatataaaaattagctgggtgtggtggcatgcacctgtagtcccagctactagggaggctgttgcagaaggatcgcttgagccccagaggtcgaggctgcagtgagccatggtcatgccactgcactccagcctgggtgacagagtgagatcctgtttagaaaaaaaaagaaagaaagatgttgaactatacacaagaaatgaaaagaaatagctgagatatggctcttggggagaaagaacaaagcatcaactaatagaattcagaaagaaaaggaggtactcatcaaggcactctgctaaggtttgactaatgggattccacatggtctgcatgtttatggcttaaatgagctaccaacactgaaactgtccacttaattagcccccaaaacaagaagtacagactgtgagtctgagacctacagagactccaaaaacagaaactaccatcgcctcaagctaatcactctaagtcctagaaatacatctgaggttgcaaacagtccatttcattcattattttatatatatatatatatatctatatagatatagataaatatatatacagatatacatatagagagagagagataaaacagaaaaaatctaaatgtctaaaggaccagatataagttaatcataaaacgatgacaacaaaaacaaaggcttcttgagttaaaaagaatggaaaatatttaactagagttaaaaagaaaagcaatttgatcaagagtcaggaattgtaggttctagtcctggctctttttattctttttatttattcctgttttttttttcattt

SEQ ID NO: 12478 - DNA, 12694 bp, Homo sapiens
  misc_feature (1)...(12694): n = A,T,C or G, or insertion/deletion polymorphism (see Tables 1-2)
tgaagttagaaactgtttcttgccttgaacaagttctcagaccaagtcagaaggcagagttctcgtgtatccaagtaaactcaatttttctttggtgcccacttgctgttatgctattcttcaaatccctagtgagacctgaccagctcaacattctgacatgcatcttcatttgttataaaaacacattactcatcaaaatataagcacattcccatacagcgtatttgatataccagggtgcagccaaattctagatgactcttggttgaagacaacttgaactactccttctaacacttttagccagttctgcattttgatagcattctctcaaatgttaaagtaacatgtaaaggagcattgtccattttaggcatcttgttcatcttttataatatcccacgaatctctttttcacttttctcaaataaaagacagcttcaagctgaaggagttttctattttaaacacaattattaaagtatattggtgtccagtgggctcaatagaaatatgtgaaaatttatttttacctagttggctaaaaggttcaagaatatggcactctctcttttacaacctctttgaaattggaatcccaaaagtcaagggaaagggctaattcacatctgtgacctattggcccctggatgacagggactaggtctcattcactgctgtgtccccagtgtttagcataaacctcacaattttgagaaactagacaactctagtaagcactcaatatataattattgaataagtaaacaaactaatgcaaagcatcaagctcaacaaaataaagcataataaatggcaatgttgggctgcgatgcattctgggaaaggagcagcatcaaatccaagacggcaccagcagaaggctgatgaaggagcttgaagaaatatgcaattgtggaatgaaaaacttccgtaacttccaggtagatggagctaatttattgacttggcaagggcttattgttcctgacaaccctccatataagggggccttcagaatcgaaatcaactttccagcagagcacccattcaaaccaccgaagagcacacttaaagatctgtcacccaaatgtccactaaaaggggcaggtctctctgccagtaaattagtgctgaaaactggaagccagcaaccaaaactgaccaagtaatccagtccctcacagcactggtgaatgacccccagcctgagcatccacttcaggctgacctagctgaataatactctaaggactgtaaatatttctgtaagaatgctgaagtttacagagaaatagggggaaaagcgacttgtagactaaaatctgccacaattggctccagtaagtgtgagcagagaccccgtgcagtgcattcagataccccacatggaaggactctgtggaaactgacacgtgccaccgcctaccactttggcagttaccaactttctacagttttcttaatcaaaagtcgtctaggcaacctgtaaataaaggattaaaaatttaagatgttctaaaaaatgaataaaaataaaaaataaatgacaatgtctgtaaatgaaacaaactctggttggaaaaacaaaaatgtggtgttgaaatattttgctgtattttgcctcataaaattttattttctgaagcaactgttaaaatgaattaacatttaaaagaactggaataacacagattattacttcatcaaaaggcagaatcacgaggagaaaaggagattcctctatattccaatcttctcttgctaggggacaatttgagtgggaaatcttttcaccatttaggtctggagtgtcctgttaataaaatgcaatgttgaaatggctaaatcacattggctgctatgcaatacatttttttagctacggcattgcttttacaaagtagcttttacatacttagcaatccagcaggtgataaatacatatgttaagaaggattaatgtactttaatggaggaagtaggaaaccaaaataaattccatttaaagagattaactgaatcttttgtaacaagacctcttttaaaatgcatggaaacagacatttgtaaactctcttctttcaaaatgtaatgtggtaattccaactactcaggaggctagggcgtggggactgcttgaacccaaaagtttgacaccagccagggcaataaagcaagactccatctcaaaaaaaaaaaaaaaccttaaaataaaaactttaaataatgtaacgcaggttaccctttacaaataaaattttttagtgaatttaagaaacaccagtatcatcaatattagaaattacgtaggtaagtgcctgcattcatatccaaattcatgaaaagagaaggaaaccattcatgttttgaaaaccaaggcataatattaaaatgtcttaactccaagttactttggagtactttattcagaaaagtctgttaacaaaagtaacatacctaccacagaatttttgtaggttacaatattgtcctcttcactaatatttccccctggagacagagtttcgctcttgttgcccaggctgttgtgcattgacgcgacctcggctcacagcaaccgccgcctcccgggttcaatcgattctcctgtctcagcctcctgagtagctggaattacaggtgcccagcactacgcccggctaatttttggtagttttagtagagacggggtttcaccaagttggccaggctggtctcgaaatcctgacctcaggtgatccacccgcctcggcctcccaaagtgctagctaggattacgggcgtgacccaccacctcttctagaatggacagtcttaatattactaatggagttttaatatatggttaatgggctcctcgctgtgacttcccatctcaggaaatgacagatccatctttccaatctctccgaatacaaatccattagtgtaagagaatgtaggaaaaaccattgtttctcctactctcacacatcactcaacacttctgacaccagattcttcaacagacaccagctgagcatcgtctaattcaattcaatcctaacactatccacctggacatagcatcacccctcagtccctcaagactgcccccctcttcagatgccaattccaaatcccaggttgtgacctgtatttcgaccaaccagttataaatcagagatcctataacccacctctttgtgtttgattaattttctagagcagctcacagaattcagagaaacatttcatatttatttacccatttattataaaaaaattacaaagcatatgaatgaacagccagttggagagctgcatagggtgaagtataggagaaggggtgcagagctcccatgtcctccctgggtggttgtaccaccttctaggaacctccacatgttcagctatccagaagtcctctgaaccctgtcctttaggttttacatagaggcttcaattctacaggtatgactgactgtatcactggccattagtaatcaacacaaccttcagccctgcagaggttgagagatggggctgaaagtcccaatcccctgaccattctggtgaccagcccccatccagaagttacaaaggggcctccagccactagtcgtcttattagcacacaaaggatattcttatcaagggttttaggagctgtatgacagaaaacagggatgaagaccaaatacatattttacaatatcacaattagcaaattcaactggctctactttaagaatatcctcctaccaccttcactgtcacctccaagccactgttatctctcatccggatggcttgcaagagagaggcttgtctcatgctgcctcctttgcccatctgtgttccagtttctcttctgaagagcaagtgaaatgatgccactcctctgcaatgtctttatcagaataaaatccacactcctcaatatgtctggcacaggcttccagggcatttctcactgctgccttcaggacctcttatcataacactcttgcccttgctccactgatgcaccctcacctgtgagatttacgcttgctgttttttctccttggactgcagttccctcagccatccaggtggttctcatttccttgcttctttcagagaaataagcaatcgcccctttatcagtttgtgtctccctgatcaaccaatataagataacatacatctcccataactacctatagataacactcggtctgcttttcttcacggcatttattcctccaaatacattactagctgttagaatgaaattttaaatgaatagaagatttacctattgttaactggaattctaaatgcttagggtagagtctggcacatagtaggcagagaactaatggtccctaaaaagtactgacaaatcaagaagagaataagatgatgtatacctggcatccaggacacaaactccagtggtaacaagaactctgtccccactactcaccaaccttgttcccgaccttccttgaacgtgagattacctctaaggatcagccttctcgccaactgttggcttagataccatgaaatataacacataatgaagctcgaggaaagcagaaaaataatgttttccctcaccccatnnnnnnnnnnnnnnnnnnnnnnnnnnnnnnnnnnnnnnnnnnnnnnnnngttttccctcaccccatctcaaaacactcaacacatggttcctcactcagtaggcactcaataatacatgaccgtctgaaagcatgaccatttttattttactagagagggaagcagaatgagacagatgacattttctcacgacttaagcttatacatttggaaggaagaaagcagttgtagtaagagaggcaggctcttcaaattctcacaaaacacaaattcctagttttgctttggatgggaagggcttcatttcaggcacgttgggggagaaagggcgaagggaaaaatgctcagactatgctatttttaagttatttggtaagaatggctatttttccctctgatattcttgaaccacccaaatgtcatgtttccatgcactgctgtctggatgctatcaaaggcacggctctgaggtgaaaggaaggagtcagtcatatgctcatcttctcacatgctgctaccactgctgattttttttaaaagctttgtgacctagaaaggagatgtacggtatgaatgatgcacagactgcagagagcatagggcgtcatcagtctatttatacctccaggaaggaaaaaatgagtacagggcaatggctctatattccaagtactgagtatgcaaagattatctggaagaaacaataaacaacacagtgagggcggcatttatgtcatcagtgagaaagaaaaggtgaggccatattcccatgttccttgatcgttccaaaattctgttaacttttaaagaatttcaagttgatcccctgatatttcccatgactgtataaagcatcccaaatctgagttaaagacactgccacccatattttaatacagcttcacctcatatgtgcatatgtatttacatttagcaataatcgatatccatttggctatactgtaagtcccgagggaaagtttttcagggttaagaaagtatttggaaaagccttacagttaattatgctacttaactccaaaaagggggaaaatgagatttacacagatttatacaatatgatagaaaaaaaaattttctcaaggtgtgtagttcatttcccttaagatgtgaaatctttccaggacaaagcagggaaaaagcacccaggcccagctgctaacagttattcctggatcactagtaaacttaatgccaggcttcacctctcgacttccatttgtttctactgtaagcagtataacatggagcctaacagaaatgatgttctgaaacgtacccattttgctcttttgcaacccgtttacttgtgcaattactgccagtttcacttgctttggagttattttactagcagtggcgatggatttgatgacagctggccacagtatgaggtgttttctaaggcttgacattaggtatttcctagtgcaaaatttactgatcccgcgtaggctccaacctagagccaggattccttaatggaacacaaactgatttactttgaatatactcaagcttcacagcaaacacttcctgtttctattactgtccaagtcttcttaccatgcctgaggcagacaatttaaggcttgattcctcaccctttcccttcatctgctgaaatcccatttagttttagtgcaccaggcatgcastggtatttcatcctatgcattccttccacagcctgacctataaagggctgacactgagtcctggcttgttcagatcagagagaattaacacttttatttctttratttcaaaagcttctgaggtaacttttgagctcgtaaatgtcaataatttgttgtcaagacaattatattcttaacccagctgctacatayagggaacatagagactgacagaaagtcagtgaatttagaattaaaacagtaagtttatctgattgactatgcttctcaaaatgtaaatggatgatacaaattaatacaaccaattcattttatttggtttggttttggtttttgaatgggtttatgggtttaasagacattgctctctgttgwttatgtgtattcagtgtcagaaaggaaaagtgagcagtgtgaagtcttattagatggaagacaggtctaaggcacatggaaaactgatattcgtgatggacaggtcaggagctagagagcagggataaagaaagcagaaaagaaaagaaaactcagctacaggtactctgtaagtgaaactaacaggtacttgataaatattggctggttgattacacaacggaggggaaaggaatggcatgctgtatcatctttaaagactcctctacatgtgccacactactatgaataggaaatcaattttcctgtgctcaataattgtagagctctcttgtctcttaacttcctgctatataaaccagtcctgcaaggtcctccctccttcttttccttctctcatattgccacaggggagctcaccgaaggagtctgcctttaaatggagataaacctagcacaaacaaaatcagttgtgctttcaataggttattgaagtacaaacattcagagggagttttaaacactttggcaaatcttctgagaggcagagtaatgatgttccataagaaaatttgctaaacgaaaataagtagaataatacctatttctcttttcaaaaagaaatttcattttcatggaagtagggttttttatgatttccatacttaatccttaatttatgctaatgcctctgtttataattttcaacataattactgtggggcaaaagaaagcaaagggacctatacagacatatttaatgtacacacagcaaacgaaaagagttagtcttatgcaatttttaaaaagctagtcaaaaaaatgactagtcaaattttttgaaggaaacagatatttattttcgatttcctaatttcatgtctgtatcctcagtcacactgacagtcatcattcattctaaaaaaaaatgaggtattacccaaatagcttatgtcagcattaattgttaaataagtacatttgtaattcctcctgtcagccatatccccttacgtatctatgcagatagtcaagctcctatatccaagttaggagttaggaatacagtggtacagtttatcaatatccatagataggacagagtaagatttcctctcactaaacatttattttaaatctccctcaaatcaatttctatataatttcttgcaaaaagaaataaaaaccagcagttactgctgacaaattaaactaggggcaaatacacattaaatatatacatttatatatttacatttgtatatgtatatttatatatacatttatatacttacacctatacaggagcatttcattgtagaattttgactcattcaaactctgttcactaccattaactgataaattatttatgaaagatgatcatgacctccattaaaaaaaaggatccctcaaagcatgatatatttctaagaataatgcaacctattttctgtgacactgctttgttcttcaacactgtcagtggatgaacgatatagttttaacacatttttgtgccatggccatgaaatgcttacatttattgtgttaagtttaagcatatgcttcaatattcagttttcaactgagataatgattttaaaagatacaatctcacctctttaggattgttttagttttcacttccaaactgctacatttgactcgacactattacaaactactagtgaacataaatttcaaaagaattgtcttacaatttcagatctttaacccattgcagtggtgtgaactaagtatttccgtgcgtctcccactttcagccacgtggtaggatggtgcttccctgtctccttgacatttggtgaggccatgcgaggtcagtgaaatgcatgaacaagtggtatgcatcactaccagccagaagtgctgagaaccagcgtgtgactaccatgtgctctccctctcctatgtgattgtgaaagaacatgtcaagtggagcttccttcagaggtaactatgataagcagtcttcccttcaatctacacaaacatgagggaaatcttttttgttgtaagccattacaatatttgtggttgttgttactgcaagatagcttagcctatcctaactaatagacaaaacaggtcatgaatatgggtcgcacactggaaatttggggtaaaaaatacattacataattttaaaagccattttaatatggaataggtagtgtcaatgactgaattccattttggtgtagaactacaaatctggaaacagattttcaaatttttatgaagaagaaggttaataagcagttcaatatttcacaagaaatgagaaaagcagagcagaatagatggatccagaaatgcaaaagggtcatccaggaggaggcactaacctaaggaaaagcagaagaatacagcaaggagatttcagagaaaggaaagtagttacaaatgaagctatagagattggcaaggccttgtacaccatgggaagaaacaagaaatgcatgctgtgggccccggaggatcataagcacatgcactatatgatcagatctgtaattccaaatggtttatctcggtagtttaaaggcagggttgaagagagggatgggtgagatgagacagagtaattgggaggaacacattgctcactctgctcaaaaacatcctgtgagtgaccacagcttacagaatgaaatatccatccttccctgtagtaccaaataccaacatcagggaacagagattagtggtcaagaccccagtccctggtttcaagttcatctgctgccacatattagttgtatcatgtcctaaattctttatccatacatttctacttcttaggtttactgtgagggctaaataatttatgtaaaatgcttattttagcaaagtacctggctcttagtgagaattaacttgtcaatctaatccattttatgacccattacataattgcactattcttcttcaatactatatttttttcactcttctgctactaatgatgttgccttcgactacgtctttctcaggtctctccctgttcaaattccactcacccttcagaacccactcaatgactatctgctccatgaaggatcctactcaatgactactctactccatgaatgctccctttgcctcaggaaataatctctttcaagtctggactataacacagtttctaattgcttcatggtacttaattatatatttgcagaatttatttttctcaattatgttctattttcctttaaccagtattacttcttatgtatccattatactcccaacagtactttgtggtagtgccttgaacttactgagcttcactgttgaataattcaaggaattagatccaatcctggcatacaatttcattataatttattagtatgatacataatgttttattcatgtgtcagaaacaatttcacaaaacgggtagttttctccctccttttactcataaataatcaaaggtgagataggtgaagtcattctaaaatggcatggcatattgataaggaatcccaaaagaatatatccatctctgatggaaaacctctagctccaggagcagaaagggaagaaagctaagcttccacaatgagttagatcacactcttcatcccacagggataaagatttcacaaactagataaggatccttgtaaacaactggctgttaacaaatagttttatttttcctcagactccaccaccaagtaaacctactgttccttgataccctttgtccaggctgtagtaaacaagtactcaagaagtgttatgtaagtgatgtgacttattgagaaatagatttgcccttgaaaagaaatatgaatagaattgcacttggcccctgtagtttgatcattgtaacgtgaaaaagatacagcctatcccagttcttttggcttaagtgagcaaataaaattaaaagggacttggagaataattttgcttactgctctgatttcaacttttctgaaatgggctttgaatattaacgtctacttcacaaacttttcactatactcagtcccaagcaacccataggatcacacagccatgccaccaatttctttttccttataattacgttaaaatttaagtcttttgggggccaaaaattaaatcctaactattccttgtaaaacctggagcaaggcaatatcctacacaccatcactttttcataccccaccacaatgttaactctttgaaacatcccttgaacaggtttctctcacactcattagactcagagcttaattagatttctttggatttatatcatacaatgacttttaaattctcatcattttttatacagtacccaaataaaaacaatcagaaagaatgtacacagaaacaattatggattttgaaagttgatatcaacttagatattggtatcaaactatgtagggaaattatcatttatgtagagttatttaatcaaaaaatgttgtcacaaaagcaaagctctactagatagtgctagctgtctgttcctattttttccagactgacttatgcaatatcctgatgtttaaaactattctgtcatggaaaatctgtctctagggtggggtgagaggagggtgtcccattttctttttaaagttataataagaagcagacaaacaatataataaacttgtactttgcaaacattttgaattacgcattgcaaggctacaaggtaaagacagaaatatgcattttaaaataaaaacttagcagacacccattttgctcgcagcatgaacaatacagtaaaatcaaaatattttgccttataagcagtcagcaataaccagtgatctgaatatttttaagtgcaataggtcatatatcaaatggagttcatttcattttcctcaaatgctaccgtagaaatttaaagactattaagaaataatgataatttcccctttcatgcatataaagaatcaatgagtataataaaacttcattcaggtttttcccttttctatgttgactacatgatatgtggatataaacagacaaaattcatactgaatgtcataaatcaatgttaggaaaaagtaaatttagagtaactttccaactgagtgagtcttgttctcttcaaaaagtgaacctttctgctcttatctcttttcttgcaaagctaagaaaagccctttttaaaagtcctattgttattttctggatcattacagaaaaattatattttgaaactgtaaagatttcattttttaacattcaaaactgacttaagaatggaacatattggtcaggcacagtgactcacacctgtaatcccagcactctgaaagggtgaggcaggcagatcacctgagatcaggagtttgagaccaccctgaccaacatggtgaaaccccgtcttcactaaaaacacaaaaaaaattagccaggcgtggtggtacgtgcctatagtcccagctactcaggaggctgagacaggagaatcgctttaacctgggaggtggaggcaggagaatcgcttgaacctgggaagtggaggttgcagtgagccaatatcatgccactgcacttcagcctgggagacaaagcaagactccatctcaaaaaaaaaaaaagacaacatcttaagtgacaagagaatccacgaatcatgggtctggctcagtgattgaaagtgattattggactagaagcaaggcacatctctggactctagttgtgtcagaggaaacatgctaactcacatcatagcaagtccatatcctgtgtgataaagatgttatgacagaaagctaaatcactccaacatttctacttcacagtatgtgcctgaatgcataccatatttgtctctactatattttgcattgctttttagatgaataacttttgaaccatattttctcatattactaaatcactaagtgcaatgtcaacatctgaaaataattatttctgtgtattcgcataaccttggaatgctgagaaatgtatttggcttgggacacagcataacagccctgacaaccctgccttaacattat

SEQ ID NO: 12479 - DNA, 1126118 bp, Homo sapiens
  misc_feature (1)...(1126118): n = A,T,C or G, or insertion/deletion polymorphism (see Tables 1-2)
aggaaactaacatgggaactctccctgtttcagcataccttacaggtcttggtttaaatttgtcttagaaccttcaatccacagttctttgggttgactgttgaccttctgctaattcactgttatttctggatataaggagtctctctctatatatatatcagagacagcttttttttttcatttgtgtgtttgaatgaatagatgaaatacaaacatatcttcctaaataaggacgcattgattagaagagttttccataagactgctgttcaacattcttccttattggttacttctcaatgagaaattatccgaagagctaggatgcctcccagatctcattggtacattgagttttgcaccaaagcatcaggcttaattttccaaggaatggcaatttaagttaaatcaggtttgcagagttgtcggggtgtttgtgtatttgaggttgggaggggaaggaaacgatcatcttcagggtaatgataataaactaataaaatgtggctccaggaatgttgcactaaaactttgtgcctcctgcatacatttcttttgagtaatgccaaattgtgttcagtaaaatctgatcaatcttatgtgcgtaaattgtcagttattgcagaagtaatcagtcaaaaagaaaagaaagtttaaatgtagagacccttgttaggagctgggctttagcctttaaaatcgtgggtggatagggccatctggtgtgcagttgtgtaactagacattgctgttttttttttaacctccttgctaataatcaatgtgattcatttgtctttacaaaaacaaaccattcttttgttttgtttttttttcttcaacttttactttaatttcaggagtatatgtgcaggatgtgcaggttttttacacaggtacatgcgtgccatggtggtttgctacacagatcttcccattacctaggtattaagcccagagtccattagctattcttcctgatgctcttcctcccctcctgcctccctctgacaggccccattgtaggttattctcctccatgtgtccgtgtgttttcatcagtcagctaccagatagagaacatgtctagtctgttttcatgctgctgataaagacctacccgagactgggaagaaaaagaggtttaattggacttacaatttaaaaagagatttaattagacttactccacatggctgaggaggcctcagaatcatggcgggaggtgaaaggcacttcttccatggtggtggcaagagaaaatgaggacgaagcaaaagtggaaacccctgataaacccatcatatctcatgagacttactcacttcacgagaatagcatgggaaagaccagctctcatgattcagttacctcctgctgggtccctctcacaacatgtgggaattttgggagataaaattcaagttgagatttgagtggagacacagccaaaccatatcaatgtggtgtttggttttctgttcatgtgttagtttgcagaggacagtggcttccacctccatacgtgtgcctgctaaggacataatcttgttccttttcatggctacatagtattccatggggtatatgtaccacattttctttatccagtctatcatcgatgggcatttgggttattctatgtctttgttattgtgaatagtgctgcaatgaacatatgcgtccatgtatctttataatagaatgatttctgttactttgggtatataccaagtaatggaattgctgggtcaaatggtatttctgcctctaggtctttgaggaattgccacactgtcttccacaacggttaaactaatttacactctcacaaagggtgtaaaagtgtttctttttctccacaacattgccagcatctgctgttttttgactttttaataattgcccttctgattggcatgagatggtatctcaatgtggttttgatttgcatatctctaatgatcactgatgttgagctttttttcatatgtttcttggctgcatgaatgtcttgagaagtgtctgttcatgtcctttgcccactttttaatgggattgtttaaaacaaactattcttaaggctttcttagggtaacatttggagaacattggctcattcccaaacataagccttctcaaaccgattaaaatctaatcctcaccaagttaagtagggcttgcctgctgatagatcctcatcagagcaaagtcaaagctaaagttcagggggacagaaactgagtaaacagaggaagccagtaaggagagagcagaaaatgtagcccatgggagggaggagacaaacctcaagaggaaaaagttcccaacacttgcatgtcttacttctttaacctcatagaacccaacaaataagttataagaaagggagaagaggccgggagtggtggctcatgcttgtaattccagcactttgggaggccagggcgggtggatcacaaggtcaggagttcaagaccagcctggccaagatgatggggaaaccccgtctctactaaaattacaaaaattagctgagtgtggtgacgctcacctatagtcccagctacttgggaggctgaggcaggagaatcacttgaacccgggaggtggaggttgcagtgagccaagattgtgccactgctctccagcctggtgaccgagtgagactctgtctcaaaaaaaaaaaaaaaaaatggagaagaaaatgtgatcatgataaccattcccgccattactggagcctggaccagccggccagatttccacaggatgtctctgacctgcagaggggctggcaaggtgggaggcatccagaccatgttacagaactcagtaatcagagcctgtgctggagccaccagcatcccaggaccaccatgtgaacctcctgacaggagcaggctcctcaatgactgaaatgaatctcagcagaactcctgtgattcataagtgactcatttactaacttattgtcagtatagattctccactgggagaagacgggcaacttctggagacatttttggttgttacaactaggagaggggcatctactactcgcatctagtgggtagaggccagagatgctgctaaacatcctactgtacagccccaccacaaagaatgatctggctccaagtatcggtaatgtcgaggttgagaaaccctggtgtcagcagtgggagaagccttagagggaatttccaaagtggtaggatcagcacaggatagaccctgaagtttaaacttcttccagggggaccgttacccagtttggggaacaccatggtatatcactagctgtgggctgatgccaagttacaggtaacagatgccagcagaagctctgggcagaggaaaccaagataaacctaagcagacagtccttgtgaaactgaacagagtcaaagataatgaatggagaaactgaggctaatcagtttgacctcattccttcctctccccacaatcaggggatcttatgactgaatttcttacaaatagcaaaggaataagtaggcttaggtgagaggggaaaggggctaaattgaggggagcagtggagcaacagattagtggtagcagatttatttttatttatctttttttgttgttgttgttaagacagaatcttactctgtcacccaggctggagtgcagtggtacaatcatggctctctgtacccttgaactcctatgctagagcctaggagtaaatactaggattactagagtaatcctccgacctcagcctcccgaatagctgagactacagacatgcaccaccacactggctaacttttaaattttttgtagagatggggtggtgggggtcggcggggggggggggggggtctcactatattgcccaggctggtcttgaactcctgggctcaagcaattctcctgccttggcctcccatagtgctgggattacagttgtgagccactacgcccaatccaatggtagcagatttaaacacaggtggatttggaaaaaaaatcttacgataggtttaatatgagtcagcaggcctgttgaaacaaaacagtgctttgttaagcttgtttttggttggtcaaatgtagaaaggcaggtgtctccgctaatgagtacgtagagcaggaatcctaagcaatcatccatttcagaacatgaagacaaaaagcagctgcccctcccatacactgcccattaaaatacatacttttaaaattccttattttcaattttatttttttgctctctcagaagaatcaaatatatgtaattattctgatggaggcttgcattctttgggacctaggcctgagaaatcacggtcagtagatttccctataacatggggctggggagcaagtgccaaacagggaatgttctgaaaactccttaggcacaagctgaagatatgtttgaggttttggatacagaacatttataggatatcttttggtggtccaagaggacttgagtgtaccttgtaaatacaggattttgtttttaattagattgattcacagagaaccaaacctaaggaatcacatcattcattcatttgttcatttaataaatttgtaggttgaagcatttaccaagtgctggcaatagaaagaagtcccgggtgtgctttgtcagtttagtcgggactacacaaatgagtcaataactgtagtggagtgatgcgatctcaactgccaggaatcccccggctctcctctcttcctgtgcctcctcaggtaattagctatcctttctttcttttattttccttccttccttccttccttccttccttccttccttccttccttccttcctccctccctccctccctttctttccagattctggacctattccagacttactaaaggaaattctctaaaggtgaggcagttttttaaagacagcagctctctctgtcgtccatgctggagtgcagtggcccgatcatagctcactgcagcctcgacttcttgggctcaagtgatcctcccccttcagcctcaatgagtagctgggactaccgatgtgcactaccacgcccggcaaactaaaaaaataattatttttggtaaagacaggggtcttgcgatgttgcccaggctgttctcaaactcctggcctcaagtgatcctcctgcctcagcctcctaatgtgtttggattacaggcatgagccactgagcccggcctagctaccctgtctgagttgtgcccactacacaaaggtgtcagctacatgtgatgtctgtgcatttctggcctggaccgcacattaagtgctccgtaaacatcagtctctattatcaacagtctctattatcaatcagtctctattatcatcagtctctattatcatgagtctctattaaacaacagtctctattatcacagtctctattatgtgttttggctgaaagaaagttctctaaaaccaggaaatcaggaatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccgscccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatatgagggtcagttcaggcactgtgcgtaaagcacatagcaccgtgtctagtaggtactctctgttccttaactgtckttccttgattrctcttaagatacgacartgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagyggcgcgatctcggctcactgcaacctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggatyacaggcgtgagctaccgctcccggcctttttttttttttttttttttttttttaagacagggtctcgctccgtcgcccaaactggagtgccgtggtgcgatctcggctcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacacaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcttttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcktgccccctgygcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgtttttttttkttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccccgctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacmcacactggctgtcctcacygtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactccatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaatmggactagtttgtgtaactgatttgttcaraataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttcccccyacttccttcttatatctggctatctgggagagaaaaaatttaatacaattgattactttttagaagagttaatttttacttattactgkggattttttkttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaayatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcatgtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacwtgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcatgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagwtctttcaggtttaakgaataagcattttggtctatgaaaaatggggtttkcctaaagtataagattgtcttatatttataaatgcytgtgttcattgctgtgggttcactgctttctcttttgggcagccatataaataaaagaaccacctacttggacccaagactggcgtttactgtggatgataatcygaccaagccaaccacccggcaaagatacgacggcagcaccactgccatggaaattctscagggccgggatttcactggcaaagtggttgtggtcactggagctaattcaggaataggtaggctcttcacttmgttatttatctttgggactgctataatgagatccacttagatctagctataatggaattttgtttagtggttctctgatttaaacatgacttttatcyttttcagmtatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtrcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttastgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagtactgttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgmatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttctttttttttttaaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgcsgactgctatgttagatactccagttcattcaaagtgatatcaccctaacattctctaaattagccacagcttagatgaaatttaggcaaatggaaygccccaggccccaggaagactgtggcagcacattgtatgtaactgttggggatgttgcctgaaacccccsccytttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaaggrccaggtgttttacgactctttggagttagcagcttgttggctctgatttggtaaaagcaacggaaatgccttcagcacggtgaacrttacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcrcggtggctcacgcctgtaatcccagcactttgagaggccgaggcgggtggatcatgaggtcaggagatcgagaccatcctggctaacaaggtgaaaccccgtctctactaaaaatacaaaaaattagccaggcgcagtggcgggcgcctgtagtcccagctactcgggargctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatattttwaaaataaatttgtaatcatgtatacagtagtccccccttatccgtggtgtttcagtttttttttttttgagtcagagtattactctgttgcccaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgttgatctcttactgtgcctaatttataaattaaaatttatcctaggtatgtatgtataggtgaaagcatagaatacatagggtttggtmctatccagttttcaggcatcactgtgggtcttggaacgcatctcccgaggataagggggggctactgtcagtgtgaacctgattagatctcaactgaaacttttttgtcacatgaggccatcagttgaatttcatgcctgcatgtaggtttagattttaattacttttttatggtgtcagcataacaaatgagagtcatacaaactattgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatgtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccrgggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttttttttttttkttttttttttttktttttttgagatgaagtcttcctctgttgcccaggctggagtgcagtggcgcattcttggctcactgcaaccttcgcctcccaggttgaagcaattcttctgcctcagcctctcgagtagctgggagtccaggcacctgccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagyagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtrcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactasactctaagaggagatctgagacagagagatgggggcggggaggaaacctatttcagtgtctctactatttctacctaggtggaggataactagccagatgaacggagctaagccttttgtatgaagtttatttcwtataaagaggaacaaaatcagaatcaaatttcttctgtagttgcacagaaactgaagttaaagctaatacaatgtttttcatttttacccttacctctacaatgtacttaattgttacagattcgtatttattgattatcatrttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgyggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaayaagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactrttggatatgtatcgattactaattgattgcttgcctcatgtgctatmatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtctggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggasaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagtttataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtatgaatataaggttgctggcgtttggggaaaaatcatagttatagaagaaagactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctrctataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgkagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgcygttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttatamatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaakgtgagaacacagtgggaaggcagccatctgtaactagtaggagggccctccccaagaacgtgaccatgctgccaccttgaccttggactttaagcctccagaactgtgttaaagaaatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcgaccctcataggatgtacttacaaatcctacgtggtataacccattatacacagaggctgtatgggatagcctgttgcttccaggctgcaaacttgtatagcatggtacygaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgtyacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtccacttgcctcagcctmccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacrgtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctrttacgacttagccctgtagctctgrgctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccrtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttawtagagacggggtttcaccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcaractgctagaacctccagactgcatgtcatgcrtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcaatgtacctagactgtttccttaaagaattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactattttttttttggggtgcagtgaatacttcgcaatgcctgctgaattttacctattctgtaagtctttttgggaaccgttgagcccctcttctcttagttgcctttagcctttgtttttattatgacaattggtatgaaatttttccttttcattacttcttttattcagagcacacctctggcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacaaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcytttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccagcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccrtatcttttgaaagaagattttttaaattccttatttttccttcctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacagaatctgcaaggaggcagcatttaactgattagaattgtcgggggtggggttggcgagagggtgttgcttttctaatgattcacattgtataaaaagcagacagtaggtctggcactgttggctcatgcctgtaatcccagtactttgggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgcgccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaagagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgggcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtagccctagatgttcattggcctgtggcagggtaattccagtctctgcctccatctgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctataaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttcttttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttcttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctgcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcastttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcgtttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacacatatatatatatacacacatatatatatatatatatacacacacacacacatatatatatatatatatatatatttttttttttttttggagatggagttttactctgtcgcccaggctggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatatyaaccatctcagyaggcttcttcgtgttcacatagtctcctcaccgtgtgctgtgtccagatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttttggggagtacttgcctcccaagtgcttaggctcccgctgctgacaagaccctctgcctggsaagccstgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccrtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaakagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagactttagtcttttcaagaggcaaagtaatataccacttttcgcttttttaatggtgagagccaaggtcaatctgaatttttctttttctttcttcctttttttgtttttttttttttttwwwaaaaaaaaggtgcttgaattagaaaggtagcacaytgtccacatggacagtgcaggatggggctggctttttcatttctgagagctggcaatggaatgaaggtcttttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctactcgggaggctgaggcaggagaatggcgtgaacctgggaggcggagcttgcagtgagccgagattgcgccactgcactccagcctgggcgacagagcaagactccrtctcaaaaaaaaaaaaaaaaaaaaaaaaaaagtgccatgtatattttgattacaaaaaatttcatgcggtgttactttctttttattggtrgagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctccyggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggtggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggattttaggagctctgtgccaggaacctggatgaagacccartatgtatttcttattatatcacaatatcacaaatscacagtcacatggtgattgtggtagtktggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaacaccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcycatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttgtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagartggcgtgaacccgggaggcrgagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatatargcgtggtgtacwtcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattaaaaaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccagcctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacggagttgctccccaatccttgatctttttttttttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcctccatggccacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatytgatagaaaaacggcatgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggtggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcacaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttcttagggttcataggatctgtagtccttttctttatttttcatttttaaaaacaactttattgaggtatgattgaygtacaaaaagcctyacgtatttgaygtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattwgtgacagtgagccccttttcatacacttggctatttgtatgttttctttggagaattgtctatttggttcctttgcttgtttttaaaatctgtggttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcttttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttatttkttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatatacaaacgtacatttctgcttgtagcttgcacayatatatatayacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtctatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggccccmaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaacygtggccactgaaaatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagygcttgactgttgttgttttttttaattgtcaaatacacatgccrggctaaccatatggagatttyagtggagtgtgtaaagtttattgctcttggaatcatgtctttatttttaaagtcatcttcactttgtttgtcttatgaatgaaagcatgagcaagtcmattattattcacgcatttgtttgtagttcattgtcagtgtcatctgctttattagtcaggggtttgagaatgtttcttcctttaactcatttattaagaaaaataaaacgtggtgaacgcccatgattgcaactaggagactgttatgcttatggttgttaagattagaaagaaggargctttaaccctatctctratttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcmttttattgtctttctgactaatgttaaaaagtagtaacctctagtaggtgggatagtagcaatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgcaggagatctcttattagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttrcgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctygactcactgcaactttcacctcctgcgttcaagcaattcttctgcctcagcctcccgagtagccgggactacaggcacgcgtcaccatgyccagctaatttttgtatttttaatacagacggagtttcaccatgttggcygggatagtctcgacctcctgatctcatgatctacacacctaggmctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggaygctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtygtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttttgcattttccagacgagccaagrgatggctcagaarggtgaaggaactcacccgaattgcacagctggtgagctcagagtcagkctccttgcttggtccatctggcttccaaactscaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgaattatacactggtgccctcacctcttaagacaagcacctatcgttttcctgtgtattccaagaggccagtgtggctggtggaataagatgttttcctgttttcaagatgsagtggactctcttttatttarcagcagtgtctatgtgttaggaatccatgtgagttctctaagtctgggacaacgataggtgtgtctgagtcctgcattaccatggtttattctttcctttacccagtatctattggagttgggcttctgttgctttatttctcggggtctggcatatcccactccctgtcttgagatctcaggacctctgaggggcattgcatktaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggggcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattmccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaamatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgataagcatcrgaaataatgactttaacattattttcagatagggagcactcagtaccaaccattatattaggctcatgggctcaacattttgctgtrcttttcatagatactgacacytgtgttttcattttgttgttgttgttgttttccctgccgggaaactgccgcatcctgtgttttcatggcatgatattaaggaacgatgggtaggatgctgaggagtaarttgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttggggggaggcatgtggtatgtggrgcgggtaaaatacgagcctcatgcctgtctaagctggtgacttggcttggaaaagatgatcattcgtcaacgcatcacaagtcacagggcttatctccattgttctgaacgatctgtagctaaacaaaaagataaaagctattaatattattaatagttgtagattaccgggaagarcgcatcctaaatcagccattagatttgttcctcatttctttgctttacaaattgtttttctgtatagtattggattttcaataaataaagkatgatataaacaagtctgcaaaccagcaagaactatataagccacttgctcaagtcaataagcgcaygctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactsatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtracctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaartagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttgttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctcyttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtmagcaagagaaaaatgaggaagaagcaaaagcagaaactgcctgataaacccatcagatctcttgagacttattcactatcatgagaatagsatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttyttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcagaagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataatartaataatartaataataakaagaatctgactaaggttattaaccattaaggtatgctgtgctaaggagcagggggccccttccatccgtagagggcagaaaggtgcctatcatgtcttcagtgtcagtgccctggtatggagctagctggccttccacaggttctggagttaatgctggagagaagtaggggtgkcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggtkactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggwtactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatgrcaggggaaccrtgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactgaacagacttgcttagttcctgacattcaaggaagaactttaacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggastcrccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgcyttgcagggacagcaaagatgtgagcaaatttgtgcaaacctaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaasaaacagccgagagatgaaatgccacagggatgtctaggttcaaacagcaacagaggtgcgtaccatagggatgtggaagccttgcttgtcttgttcctcttggtataaccccagtgagtagcatagygcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagsttaaaaggctgcacctgagagtagggggcatatgggtaaatccagctgtacccaagagttgggggcatatgttagycctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtrtatsttagggcttgtgggtaaatccagttgcacctggcagttggggcatatgttagggctagtgggtaaacccagccrcaccsgagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggkgtatacatgagtgctagtgggtaaatccagcagacgtccggactgtgcttgagggtgtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcrtaagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtgrtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatayagatttttttagagatagtatatattttagatgtataagtggataaactggaggtatggaaggtctttatttaaggagaataaatagcccaccccatcaacatgatggcccttggaaaggactcttttagcctccgcgagttccttttccgcaccaggctccacttacgaaggactgcaaaaacttgctaaygtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggtacctagcgtgtgctttccaagtgctggcaaagaaaagaaaagaawtgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaaraaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccragctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctcgctgcagtgttggattttgtaggatggtgaccgtttacagaaacctctggtccgtgagccaatttggagaaaattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggattttkaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcartctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacagcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgmctcatgcctgtaatgtcagcactttgggaggctgaggcaggtggatcacttgtggtcaggagtttgagaccagcctggccaatatggcgaaaccctgtctctactcaaaatacaaaaagttagccgggygtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgygcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcrgaatcttttctccaggtttcaggacccatgtctgttgtccttcctttaccttaacttcagcagggcaagaatggttcaagccacattagaaagcagttactttctcacccaattttaaaggagaaaggtaratgcggtgggttctagggatttcagtgacgtaacaggtgtttcccaggcattaagacctagtaaggtttccatttccrttaggtattatggatgcattccaagaatttaattactataacatcacttcattcattgtaattccttactagagttatgagaacttgggattgtgtggtttcttattcaatcgattaaaagstacttgctatagttttctaactagctatttatatgaaatttagtacttgtcaatatgtattaaatcaatacagttatatttatcaaagtggtgagaagagtttacatctgaacatagaatagattgcttgccttggccgggcgygggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagccgggattgtgccactgcactccagcctgggtgacagagcgagactctgtctcaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataatattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaakaatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacgtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccaytgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacarctgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacrggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccrcacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggagstgcagggatgtttatatgggctgctagcgcttagtttcctgccacarggagacagtaagaaaggtgacgtcaatctgagatgagagrgagagcaaaacagttcttttgaccaccttgaccccgaccttgaaataaggtggaactaataamtcccsctttgtgctggagcaagttttggctgagtttctgtcacttgcaaccaaatcagtcctatccagtatacctagtgactctctggtctccaaaggctrtgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgwtgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgrgaatttttctttgatcataggtaggaaaggtaaaaaaacataaatctgccaatagaaaatagcatcgtaatgagtttctactatatttgtttgggctttgaaaaatatgccgccaaaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagrggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtrtgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtartcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtyttcttaccgttattgtctcactggtgaccgtttgaaatgttgaagctttattrttacagataatggtggatatagtstcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtygattgacaaggatggcgtattggccaccttttgccgcagtaacaaacaatcccagactctcaaggcttgcaaaaataaatgtgtgtttgtttgctcataacacatgtggctgagggttggccrtggctccacagtcacrggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgctcagagtccctggaagaggtatccagatttatggctcatcccagacttctctaatcgaggctgttttccctctagatgccttagtcaatcagtaattaatttgaaatccaaagtttcattaagtgttattgagttctcgcacactgaccatttgtagtgctatatttcttttaaaatcaccaaaccatttttcatactgtcgtttgcatattttaacagaaaagattgtggttctggtgtgaatgacccagttttctggatatatttacttgaaatgtcataaacttattatccttctcttccacttcattgcttttctgcttttctgaagtattttgaaatcatatttaaaacatcattatagcctctgaattctatctaaagcataactaaactttaccgggtgactgttttcaaaacaataccaagaagctggtcttatttagatctagtcttatatcattgaaatatcattagaattcttatggaaaatatgttttggctgtttagrggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatcctttgaaacttaattaattttatttattattannnnnnnnnnnnnnnnnnnnaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgccttctcttccacttcattgcttttctgcttttctgaagtattttgaaatcatatttaaaacatcattatagcctctgaattctatctaaagcataactaaactttaccgggtgactattttcaaaacaataccaagaagctggtcttatttagatctagtcttatatcattgaaatatcattagaattcttatggaaaatatgttttggctgtttagaggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttwttattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtggtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctctaactcccgatccttttaaacttcctctactctttttattcttagcacttagaacccactaacgctctatgtaactgtcttacgtgttccatttcttgtttctagactgtctccctccagtagaatgtgcgttctgctatacagcagtgctgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagwcctgccaagctgttccatccccagttccttggtgcctgctggtacttcmccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagagcggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaaagaaaaaaaaaagattgaamatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaacyacattaattacccacctagcctcttattaccatgtttgtattgtttgcaaatactatttacagtcgtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacytctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatsaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttaaatttcttccattttctttcctttttacagcaaatttgtagttatggtggagcaaagggcagttttcactcctcttccctaaaactgtagtttaactaaaaagtggccactgtctcctggtagcrgttggtaagccatccagtctctgcaggcatctacgctccaggtctccagtctgaggagtctsgctcctrgggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactratggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcrcatatgtcaatatgtaaacattttatatatatatatatgcatkcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacarcaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccrgcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcaygatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgrctcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgkactccccacaaacctagttgatyccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcgtaggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatatamttaggcaaacttgtkttasttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatrattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcrgtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccaccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtrgtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatcccaggcagatgccacaaattattttgttttctttttgtatatatttatgctgtttcctcatttttaaatagtgggctttgatgactattcttctacataaattattacatatctgtatcatagaatcttaaaaattatttgattcaaatgtatacataattttcatatccctgatagatattgccaaatatttaccagaagtgaatcaagtagtttttctaccaacattatctaagagggcttgtcttattacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattacaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagttctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggyccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacastctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggmtgctggactgtgtgcttagaatcwgtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtayttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcartctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgccaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctcctggcaggacagtgaataaggggcacaacagagacacaaacacatsgctaaccaatggtctcatccgtcagccacactgcctgtctcagcatgggccctgtgtggaccattccatctcaatttgtttctgattcttgtcaattcaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcctccagggttcaagcgattctcctgcctcagcctcctgagtacctgggaccacaggcacatgccaccatgccagctaatttttagtagagatggggtttcaccatgttggccaggctggtctcaaactcctgacctcaagtgatctgcctgccttggcctcctaaactgccgggattacaggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtgtgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcccatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagaagtagataagaaaaacaaatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatggcattttcctgcttgattgtgaagatggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattctcctgcctcagcctcccaagtagctgggactacaggcacccgccaccaagcccagctaattttttgtaattttagtagagatggggtttcaccatgttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctcaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacrtttcccccagccttccctacctgctgagggctgctcccagcstaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatrtrtcattgaagtttcatccttcttcatttcagagtctgctrgaagacccttcatttaccactctctccttcctggaggtgtggaaatactctacctgggtgaggctctcgtggctttttgtgccaagtgtccgtaaacttcaacttaattgttttaaatcctttgtggtgattatgcggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacraatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctctctatatgtatatctrtatatatatttatctatatctrtatagatatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactayaggtgcatgccaccacacccagctaatttttatattttttgtrgagatggggttttaccatgttgcctaggctggtctcgatctcctgggctctagcaatcctcccacctcggcctcccaaagtgttgggattacaggcgtgagctaccrtgcccggccttacgtttcagcatctttcaatccatctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaactaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatagactagggggctgatggaggggaacacctatcacaatatgtgttctcacaccaatgatatatattttccacacatttagattctccatgccactccttatctctttagtgcagaaaacggagaggaggttcagtattcttaagaaactcccatgattgctttgaggcaatggatttaacrggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattrttrtcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttatttttttaaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccastagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagtggtgctatttcggctaactgcaatctctgcctccygggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgacgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttgagatggattcttgctcttttgcccaggctggagtgcactatcgcgatctcggctcattgcaagctccgcctcccgggttcatgccattcttctgcctcagcctcccgagtagctgggactacaggcgcctgccactacacctgkctaatttttttgtagttttagtagrgatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcwttttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattaattttgatgtaggccttttaaaatcaattcctccctgtaattacaatgctgctttatggtatttgtgatatatcatgtgaatatacttgagggtcatgagaagttcatatgtgtgtgtgtagtgtgggccccagactttcgccacactgctggctaaagtggccatgtttttgtacgtctctgcagagcttacaagttattcaacagccagatttctattctgatatgcccttttagttttcaaagcatcgaaaaagggtaatctttagaaccgaagtatttgcaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaacaaaacaaaacaaaaaaacaacaaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccaatcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttttcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgaaatccacagtggacaccagagagggtcatggaatctgrgaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaacsctatctctactaaaaatacaaaarttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatttatgtgcattgggcattttgttgatrtcattcagattaatgatggcactgaaaatgtgtaayggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaayagttyttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctygccgtgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcacctacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgctgagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggagggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagttyataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcacagtggctcacgcctgtaatcctagcactttgggaggccgaggcaggcagatcacttgaggtcaggagttcgagaccagcctrgccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcttgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggctcagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgttatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttcgagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtatggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcaccgctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccgttcttttaacctygttcaggtggcgtggggcggtgtgtttggtggggagtgmtgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcaccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatcctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcatgatctaatcaccttccaccaggccccacctccaacgttagggattacatttggacatgaaggctgggtgcggtggcacactctgtaatcccagcactttgggaggccgaggcaggtggattgcttgagctcagtcgtttgagaccatcctgcacaatacggtgaaacctcatctctactaaaatacaaaaatgtagccaggcgtggcggcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaacagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtartcagagggctgaggccaggtccccagtgagcggctgaacacacagtgattcaaacccactccagacctgtgttcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttattgggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctccccctaacaacctctacctggcaatcttcatttaactccaaactcaggacctcaatcctctgtttggcctgtgttccacgggacaggcatggggcacagatgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaaytcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagacgagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagtgatcctccccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacktggaagacactaagaaactatattgccgagaaagagaaatgtaaattccgctggataaattagcgtttgcggttacttctctctttgttgcttaagcagaggagaaacagaagtcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaaggtaaggggtttgagaccagcctggccaacatggtgaaaccccatctctattaaaaatacataaattagtcgggcatggtggcatgtgcctgtagtcccagctgctcaggaggctgaggcaggagaatcactcgaaccygggaggcagaggttgcagtgagcctagactgcaccattgtactccatcctgggcgacagagcaagactccatctcaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcacyccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcctaggcaatgtaatgaccctctcctggcctcaattaactgaggccaggagagggtcattagcaaactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaacatcagagactatatatataaaatctcacaaactttgtttcccagaaaaacaactatatttaaatgcagctcatactgtatgtaagtatgatgtaggaaaatctgttaattgtgtgacaattatgacttgctgagctgctcatttattaaaatattctccctataattaaaaatattttatttccggagacatggctccattaattgcacatttcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcatggtggcaggtgcctgtaatcccacctacttgggaggctgaggcaggagtaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccgtctgtascaaacatacaaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtrtggtaaggtagatagatagatasatacatacatacatacatacatacatacatacatataaaattaggtaagaggatacttttaatgtatggtaagctatgattgcaccactgcattctagcctaggcgacagagcaagaccctgtctctaaaaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcgtgaggctccacttgcaatatcacaatttctaaaacatgttgtatgtgggcccatttgccatgtgtgtgtgtgtgtctgtctatctatctatctatgtatctatatatatatatatatatatatatatatatatatatatatatagttataatgtggtgggttctcgaatcacagttgtaattcacatttttctccaccaattctgataacttgcattaagaaattgactgtgtaagttaaattttagatcaataatgcaaattggaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatacagagcattctgttagatacagagaatctctggtagatacaaagtattctgctattctgatcttcctgttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttccatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccatagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagagagagagagaaagaaaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatcttttttttttttttttttttttttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcycccaccgccagccctgcttaaattatcccctctttttaaacaraatatcctaatcttgcaagtggcatatcatgttccttcttttttaagagagaaggagaaattcctgcagatcatcagggactgaggctaactgaaactttggaatggatacagtgctactctcagctgaaagcacaaatcacttccatcacgtatatgagagacctccatgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttcctcccctcccctcccttgcccttgccctttctttctttctttcttttttttttttttttcagacagaaatctcactccgtcgtccaggttggagtgcagtggcacgatctcagctcactccaacctctgcctgccgggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcgtggtggtgcatgcctgtaatcccaagctacttgggaggctgaggcaggagaattgcttgagtctgggaggcggaggttgcagtcagctgagattgtgctgttgcactccagcctgggcaacaagagcgaaactccatgtcaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaarttccagagagatctgaagtagttttattggaacacagccctacacaccttcatttataagctatctgtggctacttttgcactatgccagcaaagttgagtagttgggatggagactrtatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttattcttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctgtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcgggctgtttgaaaacacacacacacagttttccagtggctaatttgaaaaatgtcaccgtattagttttcatttacatctgtcaggaaacatatctatacataaggaagtttttttttttttttttttttttttactttcaccaggtatttttttgtggagtatgcatttaattcacatttacaaattggtttctgtttttaactaaaggtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttstaagcttggggctcytcagccatgactgaaacgtacyatgagcacggcatctaccgggctgttccacatcctccctgtgkgactaggggccagggcaatgggaatcagtgcagaaataaagctcatgctgtttgctstgccatgagtaacgaagtcctctrtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacaatgtgctgaggtttcacattgttacatcctacaagcgtgcttacctgcatcaccttgctgggctgtttcagcattggaatatcactgggaatctcaagttcccaggagccaaccacaagagcttcacagctcagaattttcaagatgtggatgtaggcagggagcctatgtagtaattcaagtaaacatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttaygttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctstaagttrgggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacgttcccatttttacctataacagcagtagcaataatgctaatagtaatgatactagtaataaaatcaggataatgctgtttttaattcaccacactgtatgccatttgcttaaaatcagaaaggactcatcggtaaggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgtaccctgaattggccctagcctagttktccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggacagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcagkttagaattcctgttgratatccctctggccygaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccacgatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcgcagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaaagttcctgggcttcattctgctttgcattcatctcaaagttaagccttctggctggcaggggtttctgagacagactgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttaatgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactctgccagtggtcactgcagtttaacaaactccccccgggtgtgaaggaaagcgagataaatgcaggaaaaaggatacatttgtgaaatctggaaattttacataacaggcatcagatttgaagaatgtccaaaatattacgagtcatagcacaaccctttgctaacaccatggaaatttttaaacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttgtatcttacagaaaacaaaataccaccctccgccagaaaagtgcagaataaaaattttccactagcaaaagaaggaaaaaataaaagatcttgaatagtctcatcaattacatcttcttttgtgggtatttcctggtcttttcatgttttgacttctatctcggtgatctgacagacatgtacgatttgcaacaacatctattatatgatttaatttatacctttatcagtttgcagttatgctttacgactcttcaggtgactaaagaaaaagagggtgttttaaagtgtgtgtgtttgtgtgtgcgtgtacgtgtatacatgtgtttttctgtgtacataagtgtgtgtgttttaaattgtttgaaaaacactagtccatctctattgtattatctgagggatgctagctcgttacttgggatagtaacaagtttcttggtgacaactcctcctcccattgtcaaggaagactgaggatgtcaccagagttcgctgtcaatggctattcagatgaaaaataccttctttttgaataagtagaaaaaccatgggggattgaaatagcaataatatattaaaagctccaaggcagttatgtgtgaagaaataaagaacagaacagagagattgtgttgttttaaaaagggctatttaagagtcttgaaaagagtgtgtgtgtgtagggggacacctccctctcatattaagtattttgcaaattaaatgagtttcattctcctataaaatatgagtctaatcacattttatatgattgtaaaatgtgtctacttttgtctctatctttcatggaaaaaagaaatattcccaaagtatattataaaaaataattaataagcaacttttcatcattattttctgaggttaattattaccctaagaaatcaatttcaatttcttcagtttgaaagactcatttgtgatggggtgtttccaaaaagagagttagttaaatgctatatggaagccttcattccctaaagaaaatgcctctgctgctggcagtgatttatccagagctgtctcacccatttatgccccatgccaggagaatgtatggaaaatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtcctkctgtcctgggacccaggtgtgagtgcatagggaaaagggaggagaaatttaatcctgtaactatctccttatggaaaacaggaaaccacaaatgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaattatttctgaacagaactaacatcagaatcatctgaatcatcagaattgtgtattttggaaaaatcggattcatcaaatgaatcttcagccaacaactgttcgagaatgatgttaacatcacatgcaggaatgctacattttctcggatttgacattttcagtgatggagaactattatattttgtaaatggaaataccactactaaaaacagaaggctataaatagaatgatatccttcgtttccaaagtcgatatgctagagtgatgtgaaaaaaataataaaagcgagatatttcatggcaaagcgatctcagggtaaacactgcacaccagtaagtattcttggggcaaatgggaaaagggttaaaatgaccagatctccagagatctcactcactatggtgaagacagcgccaagccatgagggctcygccccagtgattcaaatacctcccattacggacatgtttcaacatgagatttgrgcrgggacaaatatccaaactatatcaggatcccagcagactgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatattttggggccttgtagtgtttgttgccaactactcaactctgccctcatagtgcraaaacaggcataaacgayatgtaaaggagcaggcatggctgcgagaaactttatttatggatactggaatttgaatttcatatacattttcatgtgtcacaaaatattattctttcccccccgcccccaaccatttaaaaatgtgaagcatttttagcctgtgtgctgtataagaacacagccgtgtttggcccagcggttatagtttgccaacccctgcttagagtctagctttattcagagcttaaatatgtcatcgaggtcccctctttatttawtcccttagttttgatgatcttttatgggttatattcttcaaagggaaaattctctccraatggggctgccactggcagrcgagcactgtcccatcttggcttgttcccccagtgacaagaagctgttttccccactacccttggcccaaaagccacagggagaaccaggattggcctagttttaggcagacacctatccctgaatcagtcatgtccccggatgatgcggttctctgcagcctgggcagtcaaggctggagataattctctgcttctccacrgagtctgagaggccccgttccctaatggwaaaatgaggtccaattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcagaaaggagcctgttggatggtctcttactagtggtcagcaaagaacagttcttttgtaaattgcactgcattaagagcattcctgtttccatctcattgatacctgccttgcgttctgttacctggaagcacaggtcaaggtagtcttcttgttccactgatttgatgggggtcaggatgctttcagaaaggaaatgagaagagtggcttagaacagggaaaatgtggccgggcgcagtggctcacgcctgtaatctcagcactttgggaggcctaggtgcgcagattacgaggtcaggcgattgaggccaggctggccaatatgatgtgagaccccatgtctactaaaaatacaaaaaattagccgggagtggtggtgttcgcctgtagtcccagttactcaggaggctgagccaggagaatcgcttgaacctgggaggtggaggttgtagtgagccgagatcgtgccgttgcactccagcctgagtgacaagagcaacactccatctcaaaaaaaaaaaaaaaaaaaaaaggacagggaaaatgtccaggaaggatgtggcttagctgaagatcagcttcagcttgatcccacgggaagctctggagggtgaattctacagcagagttggtcctgactgagaccagggcctggctgacctatggcagtcagcgatgagccagtgtctgctggggaagagggcggcgtggacatannnnnnnnnnnnnnnnnnnntggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaacggatacagttttctttaactcacataggatgaatgtggcatttattcctggtttcctgtggctctcctcctttagaaaacgtatttacatggacgtttttgaagcacttcttaagacatcgaaaaattaaaaaagaaaaaaaaaaagaagaaaaatctcttttccctcccccaaacaatggttacatagtgacaacagtgggttgagctaaattcagctacgtcaaggaagagcaataaaaggagatggattgttctctaagcttcactttattggatattgtaattgacatatagttgtcatttataatcatctgtccattcctgtgaggtgggagcagtaaagttaattgtggcagctcatttgcattaatctcacctctgaagggtacagtaacccattaatatcacgtcatgatgaattatcacaaataacattgaacatattgattaatgatctctgagatttgtatctcgttaaaacattttgttagctctttaaacttttaagccaacaaccattgcgtgtaggaggggtttagagatcatctgagaggtggtggtgggtggtggtgtactttgtagggtcactggtttaaggggttggacaacccgttcccatctgattttcctcttcttcgggagccaagtactttttgttggtaacttccgtctactttttgcaggatagtggtttcttcaaaacagtggcttctttgattgtaaggtggctccgattctcaaatggaatgattttcttaagatttttaaaaattaccccttcaacaccttaagtgctggctttctgaacctcttgcccacctaggcatgcctgctactttgaagtggcaagagttatctttgtctattacatcagcattcccaaacttacatgttaacataaacatggagctcagaggaaatgtgttgtttgagatgaaccatcgtttcaaatgtcacttacttcttgttttataaagtatcattactcttttcttggacacagtctcatctttgaggagtttgcagattttatctcctgtggacatttctacaaaatcaatcaacaaacttgagcagagaaatcatcatactagccacacacactctgcaggcattaataaaataatagtaaattctctttaaccaagtcctttgcagaatttcctggtagaagtttaaatgcaatagatgcagtaaagaaaagggttggcttaagagttgacttacaaagcttggtcctaacagctttttcctttatctgtttcaagagtcatacgatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaaywaaaaaaaaaattaagttagaagggagggattacgaccctcatgtgtatcaagaaacaagctccatgaagccccrtaggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcacctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatccttattcatttaaaaaaatctgctaacggaaatatttccattcagctcattaatcaattgtgattttcattcccttgttttgtaaaagctgttgcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgattttttttttcccctaagaaatggaactgtggttttcactgatgcacttttggtatgatttataagtagtatatttgggcagactcttcatactcaaagcagtaaaaaataaaataaaataaaatacaatgaatccacaaacagcttcttcttcattatgtaccctatacctattagagcatcataaaatataactatatgagtatcatagaaaagttaaagctgtctctactctgttatgctaagatatattagtttcataaccactcaatatattcatagttaatttatcctttattttaaaaaaatgtcctgcagattttaaaatcaattttatagtttcttttctgtttttagttagaaagttcattttatcttagcagctccttgtcatactgggcacccattctcttaggatgctgcccttctgacttttttctccaatacctgggagggaattagccatttggtaatacaacgggacaagcttatggtaggtctgacctcagcattcagaaaaacaatgtgaaatttgtaatatgtgtcagaactggcaatcaacgccataaggacaataaaataaaatacatttctccactttagtaaatgaggcttcatgcttcctatggcataacttttttgttgttgttgttttttcttttctttgaaacggttttaaatttctaattgcctaagcaatctatgacactccttcaatcttaatgtctgttgaaatgaactagcatctcaagcagttggagcatcatctttaactagacatcaacctggttttgaatcctttgagttttggcaaatagaaaattcatccagggccacaaaaaatatctataattttgacccagttgtagtctagagagatacttagttcaaaaagaattgtgttatcgtcatcaagcaaaacaacagtatatgctatcatctctgagatgtcacacgattattgctttttttttccttttaaattttttctttgtgtctaaagcagtttaagagctctaagtgtgctctgttttctgatggcttaacaagggactggctcaatcaaaatagagaaggaaaggacggagaccaggccaaaacggccatctcctctgattttcgattcatgatataaatttttaaacaaaaaagttacagtgtttttggtactttcactaggcttctaattttttttcctaaacttaaaaaaatttttttaagatcaattatgtaataattagccacaaaggcacaagaactgtttcagtagtggcctgttttaatgttccattctgaagaaactggtacagcctttctttcctgagtttgagctgaaactctctctttcccttttatcaggtcgctcaaaacagatttttagagtgaagcagttttagggacaacatttaggagaaacatttccctaagattccctaacatttttttctttaatttagccatttctaatgaatattttttaactgtgcaatttaagtaatgatttttttaatgcctgctaccttcaagacacttcgtgtggtcacctccaattatagactaggtttttaaatgaaaaacggaaacacttttaaatttttatttaatatggccggtgaaacatgaacaatatatgatcagttggcaggagacagtgtgatgaattatttatgagtttacttttttttttttttttgctttaacagcacatacatatatgaaattcattaccaagtgataggacgggtaacccagaggttctgatgagggccaggacctcatggtcataaaagtaacattagacctattcctagtaatttgatctaggttggcctgatttttgttgtggtggcagtggtggctrtggttgtcaatttaatggaatgtatttggaaagagcaagcttcttcccaatgcagtgttttccctgcaaaggagaagaaatatatttcttgcctctctttccttagtcctgtgtgcttccccttgatttcaccaggacaattttataccmatcccttgtattttagaagagcctgatacatttgcaaggwctctctttatattcctgaattttgcatccctagacatcatcctttttgagagagaaaattccgagtgtcagttttcctttatcggaacctccttttatttgaactaaccacaatgggtcrtaatttataggcccagtcagcgcatcattgctcagatagagtcatttacctacaagtatccatcagttaggtgggggctgctagattttttaagtggaaaaaaatccaaacaggttcaggaagaagaagaaaaaatcatcctgggggcagaagaacaacaacaaaaaattttccttggggccttccaatttgagattgttgagtgttgccaagcaaaactaacacgcagtgggaaggttctgcttttctcacaaattctcggttaacacaaggcgtgccaacagctggtagagcgagagtcagggtgccaggctgaaatggagtggaaggcagccctggctggaagtcttgctgggaacctggagcgctgggaggtaaaactttacttggtgctggcagcgtcactatgccagtctgtttcttcccgagcttcaggccatgctgatgttcaagttgaataaatgagagctaatgattttttaaggcgtttttagtgaattgccgtgggaatgctaagttggcaagaataaaacctaggcgaggagagttgatttttgatgacccaaagaaggcatgtcctagagtggtttagtagagctcgaatagtctaagattgttccacatcaggaaaagtgtacagttatcagaattacttactaatgaaaaaaaggggaaaaaaagattattaggctgcagggtagtgggaaggaacagggtagcaactctacagtgacttggtctgagaaaccctgtaacttggatccagccagggaagtacttttcccaacaatcggttccgctgtcctgctgtgaccagtaacaggggaaaaaaataaaactcccctaaaggtaaatgattcacctcatgaacgaagggaagaataagagacctaagtttatatacacagattccaattgtaaaatcaaacctattttgttttctaaataaacaatatttgaaaatacaacattgcagtcttgttttcttttatactggctaggatggtctggtcctttagaggaggtcctgaataaaataatatgggctgtagagagaaacgccgtttgcttgataggtgtttttgtaaaggttttactggcctacagtgtcagtacattgcaaatttaagaatgttcactgacatttttagtagccacttaaaaaatttttctaagcaatgatgtcattgtattttacttataatcagaagtacatcagcccgtgaatttagttaaaggtttttaatgtcacttttattacatttttactgtgcattcatgtgcacacacacacttttaagcatttttgatttatatatccctctgcatattttgtgccttgtgatgtgtttaacgaatgacagtgtctttagtgcattgctrcttggggtttctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattctyggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacartgcactttctctctctctttcttcttttggtttatgatgtttttcartagtgtcatggaactcacttaatctgatttcatcaagtaaatatatgggaagttgagatgacatatttttatctgacatttgaagaaatattcataaaatagcagataaaatatttattttggccttttcattctgatctctcttttgactcgatgtgtattctttgcttaaggaccacagcctaatgttattttgactgcatttcacagtgttggcggcctttcagataaacagcatatttgtggttaattggctgaacatgttctataattataattatattaaaaccttaatgttcttgaacgtttgcccgcgaaggccactcacgtgaactaagttatgtttctgtcgttataactgagctggctggcggctgccattcagcaatccaggcaggactgggaacctgggaaaactgcagaggtttcttattatttcggtctgaaaccgctgtttggatagttttagaagttgaccatgaaaattgccttctggttgtaacttggatccccaggtttcaatctgtgggctaccgtttcttgggattttcagaaaggattggcttggctttttatcaaagttacacaacggctgtaaaaaataaataaaaaaaaagcaaaattagcactttatcaagtttggggcatatttccaaggccaccagggagcagggaargtcaccaaaagaccgctccttgaaaccaggcaagaagccatctttgcagtgagctgagaggtctgatggccgccagctgagggagggaattccccttttgtgccttcgggattgatagagaagcccagtggacttagcatctgggaatcccagattgatcttttctggatattgggtcaaccataagatggtacctttccctgtgtaacaaagtcagattctgtgaaacacctgttttttgtatggctyatgagatgaggatgatttttacctttttttttttttttttcccttgagacagtgtcattctattgtccaggctggagtgcagtggtgcaatctcagctcattaacctcaggtttttttacagaaaaagtttgccaccctctgatctacatgatgtccttcagtttctgtctctcaccagactgatggtgccatgagggcaggggcaactcctatcctaaggcgtggcccatagtaaggggtattggttagaagaatgaaagattgaatacrtcaaagtgatgagtacagagctgtctgtcattttcttatctttggcctaacaactgaacacattttatgaaatttgcaaatctgtttccaaacatgtttgaatggatttttatggtcttttaattaacccaataaaaatggtaacaacacagcaattttaagaaaataacagagccaagtattttttatagctatgcatgcaatccacattacacccacatgcagtatttctatggtccaaataagtatctgtcggacttagaatatttaaattaggatttagttgaaagattatgttctatatcttttttttttaaaaaaaaggaagaaaaataaagctcttcctaaatttatttacatgttggagcaattctggcactgctaaataaggcaggaaattccattaagtttaaatgtgctgcccttaccctaaagtgtttggagggcttcgtagaagagccaaatagattcacacagatyttatttgtagagctgaatgtgcacttcattaaaatactttgtaaggtattcaaggatgggctaggagggtgaggattccaaatcagaatcttcaagccagtgatccaggccaaaggtattctgccagagtgtgaggaaatttcacagcctcatggagacacctcccctccccacccttgttgaacagactctggaaaagtcaccatttcttgttggtcctttgctcttggagcattcttggcctgacctgtcaaccactttagcctccaaggtatctgagcctttctttcgcctctctacttagatcatattcttcctggattttggaatcaggctgggacacaagccacctcctcctccattctagctgtgtggctccaggcaagtggccacacctctttgagccactagttaactcagctgccaaacagggattatacatttacctcttggtgttgcaagaattaacaaggaggatatttgtaaatctccctgggagctggatggtgcttaataagcaggcattaagggttgattatctttgcactctctcctgccagattttgtaactgagtccaggcatctttagaaacagaaatggtccctgctcttctgtatcccctgggataacctagcatcatttcgctgggttacacatcctctcttctctcctgtatgtcgtccctctttcttacggtggttctaagctctatggatcacttgtcttctcctctgagcgggaactgggcaattggaggttctttcccctcccgtgctggtgggagaattgtttagtaggtcataaagtggaatctccattycagtctgatccggtcaattctggtaggacttcatccaagcacaaagaaacctttgttttcattcaagacttccctaaaaggtggctgggtgcggtgctcaggcctgtaatcccagcactttgagaggccgaggctggcagatcacgaggtcaggagttccagaccagactggccaacatggtgaaaccctgtctctactaaaaatacaaaaattagccaggtgtgttgtcacgtgactttaatcccagctgctcaggaggctgaggcaggagaattgcttgaaccctggtaggcagaggttgcagtgagccgatgtcatatcactgcactctagcctgggcgacagagtgagactctgtctcagaaaaaacaaaaaaaaaaaaaaaaaaaaaaaaaaggctttcctgaaaggtgattcacaggcctcttcggatcccttcgtgtttagcaatttggatttccacacagccttgctgtgccttctgcccatttgtcctctgctgctggtccctgggtgggacagctcccctttctccttgtctgggttgctcagatagagccataaggattctccctgcctcaagagctgacttccttccacgagttcctaaccacctgtccagttgattcttctctggacctgccttgacatctctgtgccaagcccagtgccggggttgcagatgcagaggcactggtgcatatttcttgagttgaagagcttgcaactgatgagccccttccactcagaaaaatgttgttcctggtcttgccactgcctggaacccaccaacacctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggacgggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctckaaggtctcctggtaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcgagtttaagagcaatatggaggaaccactggggattctatgcatgatcttaggggaagtagcattattatctccaacactggctgtttacattatcagaataagaatggttctccaaggccaggtgtggtggctcacgcctgtaatcctagcacttttggaggatgaggtgggtggatcacctgaagtcaggagttcaagaccagcctggccaacatggtgaaaccctgtctctactaaaatacaaaaattagccggacatgatggcaagtgcctgtaatctcagctactcaggaggctgagatgggagaatcgcttgaacccaggagatggtggttgcagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttctggagtgcagcccaaagatctgcatttctagcaagttcccagatgatgttgatgatgatgcctgtttgggtatcacattagatgaagggctttgctaatttcagctgcagagtattgactcatggggtaggattcctgccatctgcagcttctttgggtcatcactagggtagaatcttattttctgagtatgaaaagcatcaaagttattttagtaaaatgcttttgctgtcattgctttaaaactagctcttcgaagtgggaaaaccaaaagttttattgaagcaatttgttgtaaatatgagttctgtatcacatttgggaaatttgtaaagccttactttgaatgtctttttcttcactctatctgtattgtttggtgctttctatataaatttataaattggatgtacckccacagatgtcggttttctggtaataatacttttttacattaaaaaaaactcctgaaatgaaaatgtaacttagtcttattattgtaatctccccttgcctttttgcatggatcatttgtttgtgaactggttatttcaggaagggctcaaaggtaatttcatggtttatagcatttatattggcgccttcgatgagcaaaacatattgttttctaatacatgaaaccaggaattcatatatatatgtatatatattattattattattttcattttctaaaattacatgtagtacatgtatatcaacttcaagacattgagaacaaccatgtacagaaattatactctgtacacaggggaaatatgaaagttttgtaatgcaaaaaaataaaaaaaaatcaacatttgcaagcttatgagatgattttatttttaatgaatccaaatggtagcagggagctgctgttgtgtttgtgcattgtacagcaattcatatctaaaaataaagtaacatatggctttgttattatttagtttaggaattgatgcacctaaaggagttttgagagctctgggtctcgttcggttgttgtacatggcaaccaaataagagtagctggagcagagactttctcttcttcagattattaagatttgagcaattcattttttttggatggtgtttattaaagtmaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtrtcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatttgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagacggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttgtctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcatgagaagggactaatacaggggtgatcacaaacagcctgcagactgggccatckttcttaggcaggatctcgagctaggagatgagaagagctctataggcaaaaagaatgacttggaaggccacatatggcagagtagctaagactttggggtttccagtttcagatagacatgggtttgtatcctggctctgcccctcaatgcctgtgtgatcctgggtagtttgcttaatccttatgagtcccggttttctcctgtaaattgggattaataatagtcacagctagctgggtgcagtggctcacacctgtaatccccgcagtttgggaggccgaggcgggcagatcacctgaggtcaggagttcgagaccagcctgaccaacatggagaaaccttgcctctactaaaaatataaaatttgccacgcttagtggcacatgcctgtaattccagctacttaggaggctgaggcaggagaatcgcttaaacctgggaggcggaggttgtggtgagccaagatcgcaccattgcactccagcctgggcaacaagagcgaaactctgtctcaaaaaaaaaaaaaaaaattatgtccttctagattgtgaggattaagcaagaccatgcatttacattgtttaacactgtccctgagacatagtaaggcctcagtaactgttagctctcttattgctaccggacaagtgttcttattttcccttttcttcttcttccttttcctgttccttgcccttcctctttcgaagaaagtttacgccaaaaaggatgagctgggttgcagccagcattctggtttcacaggagcctaggagatacatggagaatattctgaggctaggttaaatagtttgtctccagtgtgggtgttagtcatattcttatcagtatctgaagaacccagaagactgactctcagaacggaaaactcttggctagaggattccgaaagctagcgtgaagtggaggctattactcagtgggtgccgtaacatgtctgtgtcacctggcacctttttattctctaatctcaggagtgagtgcttcctcctgccgtgcctggccacttctcaccttcagagtctttggtatgcataaattcttcatcacttcagtagagtgaaccctgattacctacatttattaatgaaaacaaccaagaatagttgagcccaaaagtacaaatcaatgtgctgaatcagtttatgatgtctccctaatttctgcacatctgttgagctgtgatttcaaattccattccatttcttttcttttcttttcttttttttttttttggagacagtgtcttgctctgtcacccagcctggagtgcagtggcgagattggcaagatcgtagctcactgcagcctccacttcctaagctcaagtgatcctcccacctcagcctcccaagtagctgggactacaaggttgtgccaccatgcccgcctaattttttgtatatttagtagagatggggttttgccatgttgcccaggctgttctcgaactcctgggctcaagtgttgtgccctgtttggcctcccaaagtgctgggattacaggtgtcagttaccgcactggcctggaaatcctatttcttgtcaagcaggacatcaaagttgagatctaagaatttggactaaaatttggggcaggttgtttccactactgtgtattgagagatggcagggaccatcttgccgagtccaagagattgtgaagtctaaaaggcttggccgcagtgttggttcatctgtaacagctgcctacaagggaatctttgagaaatacagattgctgcatcttataagaaggacagtgcttaaaacagaaagaattgagtagaaattaagacatagcttgatttttttccaacagaatcatgaagtctgttcaattttctttttaaaaagtaatttaatcttctagaagatatctacgtttattcaataatttcctaaggtagtcttcaaaacctaggagcctaggagatacatggagaatattctgaggctaggttaaatagtttgtctccaatatgggtgttagtcatattgtcatccgtatctgaagaacccagaagagtgaccctcggaaaggaaaattcttggctagaggattccgaaagctagcgtgaagtggaggccgttactcagtgggtgccataacatgtctgtgtcacctgccacctttttattctctaatctcaggagtgagtgattcctcctgccatgcctgtcctccctccctccctccttccctctcccctctcccttctcccctcttctctttcccctgtctccttctctccctcccttccctctcttcctttcgcatctgacatctccaaatagtttttcatgcaatggcattactaatggcttgactttttcgggaaatgattcattactttatgatttcaattcagtaaccattttcagctatgccataaatttaaatcctttaccatcaagataacgtttttttctcctgtcactgaaatattatgattggaaactatttttaaaagttgactctgtttgggacagctcttagggatttgtcctttataccagcatataacttgtaggttgtcagtgtctccaggggccatatgttcaccacctagactcaacagttgctaatgttttgccatgttttgtcagttcatctatctgtccatctctttgtccatccatccaactacccacttacccatccatccatacrtttatccatccatctacccacccatccrtccatccatccatccatgcatccatccatccatccatcatccatccatgcatgtaagttgcagacatcaacaaactttacccttaaggactttggctggcatctcctaaaactaaaggcattgctgtacgtaatcacaactatcatcattatcatgtctatgaaattggtaataatttgctaacataaaataatacctagtccataacaagatttactgaattattcacaaattgtcttttatagctttttgttttcaatcaggctgtaaagttcacacattacatttggtattgtatcttattagtctgtttattaaagagtttttttcagggatcagggttagagggaaggctcctttctggatactgtgtatactactaattttctttatcggctaccaaggttttctttatttttttcatacttttctttcattgaggaaacttattgttttgtacattttgttgtacctttatgaatctggttttgacttctggcccagctaagaagctggtttcctttggtgaaacatgggagaagagggaggaaaaatctgttaattagaattgtgggcgtgcactctgtttatctctaacagaataggcttcccacggctctgagctggaaaggaagattcaagtctcaggttaaaaaacaaaccctccaagacctcagggctgtttgcctgtgattagagtctaagaaagactgagaattggaaatcaggactgtctctggtcactgatggttcaactacagcacagatgcactgggtaacagacacaccgccaggcctcaggattacgttacctagggttaggactgagcctttcttccaccttcttggggttggagggcaggaatttaacatatcttagatcacagagtaaggcctcttctacccataagtttggtttatacatcaaagtaacattctaaaattagatgagggtgttttttttttttttctttttgagacagggtctcactctgttgcccaggctggagtgcgatggcacaatctcagctgattgtaacctccacctcccgggttcaagcgattctcctgcctcagcctctctagcagctgggactacaggcgcctgccaccatgcccggctaacttttgtatttttagtagagaaggggtatcgccatgttggccaggctggtctcgaactcctgacctcaggtgatctgcctgccttggcctcccaaagtgctggggttacagatgtgagccactgtgcccggccttagatgaggtttgtagatgtgtttttcatattcccaaagccatgaaatttgacaggtaaatatatcagttataaaagttttagsattaattatcaactaactcccagaagttgcctcagcctctctttttcagccttgtcttgccccagcccagagacaagccacagctataggttttatttctgaaggagaaaactcagtggaccattccactgcctcaggagatattgcctacctgcagacatgttttgtcttatccacacatgatgtaaaaacaaaataaaaatgctgagagaaatgccaattcagaggtttcatataaaaatatagctttcccattagacttgaaaattggaagaggaggtaacaattggccagtgctgagtagagggcatgtggtctctactttgccacaatctccaccataccttattgtctcccttctcagtcgaagcagctttacacactcctgctacttgccaagacactgtacacatttaagtttgctacctgttacttggcatatctcttggttcctaagagttttaggtattatgcaatttgccagctccctcagcccctttcctggctccaaacctttggctttggtttgatgttactgggttgctgcaggaaatttccctgtggacctcactactttatcaactgtaatggtcttgttgaagacaaggcttagaacatcatcagacccagagcctttctcagaggacctgggagaactctccatatggattttcatttgggaagatagatgctcttattggaacagctggttttccctttaaaacagggagtccagcagcttctaggatgcttagaatcagaattgttgctcactttttaaggtatagagtakttgtcttattcttaactacattttatatctttgcccttttttcccctactttaaataaaatctatctctaatttatgttacttaagcaatgacaaattctttttctgatagacaaagtaaagtataaataaataagacatccaagtaataatcagaagtattttttatgttggtctcattgtggtctttttaatcccaggcctgatgcgctttaggtaccagccttggttgaagaggagcttgaacagcctacacagacatgaaacttgagcaactgagctcatggacgttgcttttaatcaggatccagaactagggagttgagtgagcttggatttgagctccacttttcaaattttcaccacctgtgctctttcgtttttgttttttgtttttgtttgttggttggttttttgtttttttgagatggtgtttcgctctcgttgcccagtctggagtgcaatggcacaatctcggctcactgcaacctccacctcccggtttcaagcgattctcatgcctcagactcctgagtagctgggattacaggcatgcgccaccatgcccagctaattgtgtatttttagtagaracgggatttctgcatgttggtcaggctggcctcaaactcccgacctgagatgattcacttggccttggcctcccaaagtgctgggattacaggtgtgagccaccgtgcccggccagacccgtgctctttctcccaccactgccctgtgccaaccaccacccccactcctattctggaaagagccaagccgtcagctattgcttttgaatctatacgcaattctagcagcttcttttagagcccttttaaattagcatgaaatagttttactagccctgaggtttcagccaaggagctttaaaggagccagccctttgtttacttatttttcctcttctgaacatttggaaacatagcttcggtgctccttctccaagaaacctgagtcatgacctccccaaagtgtttccttcccgtggcctcttctcccgatcagctgtttgttatctgagggattcgttaataaccaggacatctgattctcatcattactcatcctctgctcactctcctttctaatgcataggcctttagccttttactttctacctttttgaatgctatacttttttgtaaaattttaattaggttaatgcattgacattgttcaacattcaaacgatggaaagggtgagtgtggaggtttggtttccccactttttccagccatgctgttgccttctgcagaggcttctagaattttcagatgaatgagaatcctttcagaaatagtctctgcaaactccagcacacccatagtgctagggtgggtcttagtaaaatgtctgcagggtaagcacactgttttgcactccacacaattcacttcacaatatttcatagagactttttcatattaatatataaagagatatatacgcgtgctgcttcacgataatccattgcagagctggtctgtaatttattcaagcattctttgttgatggatgttagggttgtatccattattttgctattatgaacaacaccataatgggcaaccttgtacacatttcctgtcaacatgtatcactgaatggaaaggatctattcctagaaaggatccattcctagaagaggaattctgtacaatatggccaactttctctctgttgaggttgaaccatttgacacatytcgctagcattgggaaaatccccattttcctcactatccatttttcttcctctctttccttcctcttttcccttcttcctcttttttttcttttctttccttccctttttccttttctttccttctttccttgccatttaaaacatactgataacttggcagcacagggcagtgattaaactcaggcactcaycccaccctacctgggaatctgaattctgtcttttctgctgctgtggattctcagtccccaagttgtgtaaatcaaagcttctcctgccacactagtgtgtattaggccaggacttcatagtgtgattcaaatcaccaactgaatttttttttcctttycttcccctttctgggggactacgtttttcatggagaccggggccctccagctgctgtgatgatcctcccttgccagggaggtgctgttaatagcaaatgccaagtgagctggtgttctgtccctccggcctccttgctcacaatagccaggaggaaaaagccatgtaacctctggatgagtcccttggccatttagaagtgaaatgaacatccaagaagaagcatagacaatgtggaggaagaactcttccaaatgatggcagggatatttggaatctttccccctgagttccctctggaagttaaagcccagatcccgtgaactgattaaaaagcyscagaccattcccgttccagtcatcttgaaactgagcaagaccgtgtcatccatggagcttgaacataggagcactttaaaaaaaaaaagaatgaaaagcccctttcttgttttggtaatgatttaatgacagaaagtcacccacccaccacttgggtaccacgcagcccacattaaacaattagcccttgacagtggatagttcaagttagtttgaaatgagaaattgccggtgacctgaaacccatcattattaaccttgtggcacaacattgccataaccagtagccaactctcattttttctttttcttttttttggttggaagaaaggctcattgaggaaagttggctcagttcttttttgagtgaagtggtcagaccaccaagaattactttcctttgattgggaacaggttctaatacagatgtcctttacatgggcaatccacttttctcattgattccacaatcaattcgagctgtgtttatatatagacacctgcccacagagaccatgtggagaagcatttgcgtctcgctgcctgtcttccaaaggatttgccttctagtaattcatgtttttatagcttaactacatttatagtgaacgggtggcttcttcatccaaagaaagaacaaatgacaaaaagaaaaattttgatgatttgggaaccgcatttatggaataataacattcatgatacctctggataatgacaataattacagtatacgattctagaagggtgagtctagctgttcccagtgtgtttccatgggttgttatgtgttactggtcaggcgatcagggatttgctgaagattttctttcccatgtggcagtagatatttcagaaccctgcatcatggtgtccacagaagtccccagagttgtatgagagttcatctgggcacctttcccaaaggcaggccccctgtgcagcttcaactattcactctatttataatgttgttcctggatattgggcttgcttccacttgtggccaggagaggatatttcttactccagatcaaagagttgagacattgccttcccacaattcccagtgagcccaactccttaccacaattcccaccccatgccttccccaaattcctgatgagccctatgccttcccacaattccctgtraattttgctccttcccacaaccccagtgagccccactctgtcccataattccctgtaaatctcactccttcccacaatccccactgagtcccattccttcccacaattccctgtaaatctcactccttcccacaatccccactgagccccactccttcccacaattcccagtgaaccccacttgtgtagtgtgtctgtgagtagtctgcccactctccttatgacaggtttccagtattatctgtttcmtaacccatttccaaccttctgggttttttccttcaacgttttcctgtgacagttctccattatatctttgttagataatagttagcaacccattaataacttccaactttttgagcctctaccatatcttgttttcactgggatttctacaccgtggctactttgtgggacctgacttatcaagaacttaagcagcatctgttagaaaaggtattttttttatgaagtaagtagggaactaactacctgttcactgctgcccgttcattgctagcacaatgccaagtgtcaaataaatgyttcttgaacaagtgaatagagtacgcttctaggcttctggaaacggtgaatgttgctttatgtggcaaaaagggactttggagatgtgatcaagttcaggatcttgaaatggggagatgaacctgaattaccgaagtgggccctaagtacaattataagtgttcttatgagagggaggcagaggggactgtgactacgaaagaggaggaaacagggagaagaggtgaagcaggtgtgaggcaacaatctggtggcttctagcccctgaaagaggtgagaaatggattatcatttggaggattcagaaggaaccagctgtgctgacaccttgatttttttaacccagtgaggttgattttgggcttttgacgtccagaatgataagagaataaatgtgttgttttaagacctaagatcatggttatttgttagagcagtgatcagaaactcatacaagtatgaatgctaagagtaaaggcacctgcctcccacatactggacccttaatattccttttcatgggaggttttgcagattgctgccctccttgctctccttactcttctccttttactgaaaagatatttactagatgtctagcatgttaaagactgtaccttaaaaaaaaatcacactctaatttagcacagtttcaattgtggttaagcaccatgccattcacacttcagaaccaagctcagatccatgtgtgacactctggaatgtggcagctgatggaggaagggggctgaagttgaatctgcactagttgagttaaccttcccatggtgcctgcactagcagggactggactgagaccccagctttcccagtcaggccttcatttttctctcatggtgagagctttggaaataggcagtgcagtgtgggagtccttcccctagcatgttagtggccagcaccatgccacacagccacccagagctgcaagagagtctgcagaggtgattgccccttgctaggtgagtgtaaaccaaaaataaattctaagctccccaagcaactgaatggatccctgcctctgggccaaggggattccgaaataaacctgaaaaactagttcaggcagtgatgggaagagggggttggatatgactcattatacccttctttttttggaattcagtcacaactgaacagcattagcattaaaacagatcctaaggctgacaaaacagactctttatagcaataagataccaaatttcaaccctactctagtataggatcactttgcagatagcaggcatggaaagaaatcaaattattttaccccaaaatatatttctctggtatatttcgaaatggccctgcaaagctgtttcttgtctacattctgtagagaacatccttccctttccaggtcttttcctgatccaggagagattcactaggagtctggcacctttttagttttgataagagatatttaccatttattctctctgaggcctatttcctggaggcttcatctgcatcataagaaccttggtctttttgtggacttatcttaacccagatagtcctttctactgatgccaggtgtttagctaataacacttttaaccaattgccaatcagaagatccttgaatctacctgatacggtttggccgcatcgccacccaaaatcagacagtcctatctgttgatctcgggtgtttagctaataactcctttaaccaatttccaatcacagaatgcttgaatccatgtgatatggtttggctacatccccacccaaaatcagtcctttctattgatctcaggtgtttagttaataactcttgtaaccaattaccaatctgaaaatccttgaatccacctgatatggtttggctgcatccccaccccaaatctcatcttgaattgtaatccccacaatccccacatgtcaagggagagaccaggtggatgtaattgaatcatatactcccgatagtgagttctcacgtgatccgatggttataaataagtgtttggtagtttctctgcgttcattctgcttcctgccgctttgtgaacctggtgctttgcttccactctgccctgattataagtttcttgaggcctccccagccatgctgaactgtgagtaaattaaacatcttgcctttataaattacccagtttcaggcagttcttggtagcaatgtgagaatgggctaatataccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcaatgtctgtcttgtggtcctgaagtctaactctaatcctggctccactatctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattattttcccttcctcctccttccccctccttccccctctctttttccttttctttctatcatcatccatagctctcttgccccattgttttaaacccatctgtttttgtttctggtaactgtatccaaaagtaatacagaattttccgtaagaacatttattgtgtttccttctacccacgaattktcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcctttggctgtgtatctaaaggacgtgccattgcagctaagtggacctgaatgtacagtaagacytagtggtcaccagaatgcatgccaccccggtgcttctgcatgcaaagggtgcgggccatgtgccagtcacagtggaaaaggcatgcttcgtgtcagcacatttggcatctctctgggatcggggatttataccccaaaaccttgctctagagatttggcttccattagcaagggtaaggcttgtaagaaaggagttttactcacctttgcttgctctcacagctgtgtcagcccattttcatctcttttcaatgttttaagccctgagagaacccagttcaattcccagcaagaaatgagcctctgtaacgcagccccagacccaccttcgagggtaggggcacccttgttgtcacgatgtacaggagccaggcttggcatcggagtggatgcttgggaagccccagagaaatagacgagtgagtgcaagagccagctgcctgcgtggcttagaggaagatttcaaacacctagtgcactgaaagtctgacttaatttgtgatttgtgaatagtctcccagaagctatggggtacagatgtgggacttgtgaaaaataccagacatcctgtgggttaaagaaaaagaaaggggggcggtgggtgaagtgtgagcaatttctggcagctttgtgggcatttattatgtctaggtggcacagtgtggttggactggttggtttcctatcagttgcattccctgtatgtcttcagccaatttttttggtaatccaaggcctgatgtatataaacaaattcctttcttgatcatctaagcaatgaacacttaacagagtcaagcttggagaattcagttcctaccacaaggtccggaatggaggatttataactgggagacagaaggtatgctgaaaggtactcaaactgtcacttccttcacccccaggagcactgaagcagacactgattcctctgcagttgttgggcttttgagctacttccctcctggggagatgcgtgttaactgtttmatgactggcaatgccgtaacagtgagcaagcaatgtgaccttacaaatacatgtgcagaaatgcagatgagtgggcctaaagaatccagactcaacttacttctagtggtaatggctgtaggagagatggggagtaggagaagaaaagccaaaggcagactttagtctggtttataatgctttaatatttttttgaaggaagaaaaatgttcattacttaacgtaataattatttttaaaaagcagcctggsgggggggtattcatttttctgtggctgccataacaaagttcttcaaacttagtgtcttgagacaagacatttattttcttaaagttctggaggtcagaggtctgacacaggcctccctgggctaaaatccaggtgtcttcagagctgtgttcttttggatactgtagaggagaatacatttcctggccttttccacgttacagagactgcccatgttcctcgatccatggctccttttcggtcaccttccagccagcaacattgggctgactccttcaatggccatgtctctggttctttgtcttttgcctcctcctcttacttttaaggacccttgtcatttcattggtctcagctggatagctatcaagggtcactttaaggtcagctgactagcaaacctaattctatctgcaaccttaattcatataacctggcgtagtctcgattttattttaattttttaattgaattcagctttacagtatcttttgtagggggtaattttagcttctttctccgttgaaaacttcaagtaaggaaacacttayattgctagtgagtggccagctggagttgtaggtctaattctttttttttttttaagacggagttgtgctcttgtcacctaggctggagtgcaatggcatgatttctgctcactgcaacctccacctcctgkgttcaagcagttctgcctcagcctcctgagtagctgggattacaggtgcctgccaccatrcccagctaacttttgaatttttagtagagatggggtttcaccacgttggctaggctggtgtcgaactcctgacctgaggtgatccacctaccttggcctcccaaagtgctgagattacaggcatgagccactgtgcctggctggttgtaggcctaattctagcaatctcagcaactgtaggatttctctgcattggaggaagcaagactgaaggtcgtctggctttatggacaatgtgcttagaagttcatgccataccttaggtccagtcttgtgactgaaccaaccagacaggcctaggctctgccctaagtggtcagcctccgaggtggtagcacgcagggcctcacttcccactgcctctgtctatgggcatgtgctgtgtgccattctctccccttatcagtgggttcccagctgcctggtgtacaggagggttaagtagatacctgttgagtgattgtgaatrttttcattcacgggggcagatttgtgtcctactaacaccagacatgtcctgttttcagattacttctttttcaacatctgagtacctataacatctaaagaataacaggaaaatccacctgggtggccaaagtcaatgtaatgggcagaaagggcatgtggtagacttggaaatcagacatcttagactccaacacagggctcttccacttgctagccatggaacctcagactgggatccttgacttccttatctataaaatatggcttataactcaccctgtattatagatctgctgggaacatgatagaacgtctgaacagtgctggcttatagcaagtgttcagagatgtgtttcgttgtttttcttttttctttttttgagatggagtttcactcttgttgcccaggctggagtacagtggtacgatcttagctcaccacaagctctgcctcccgtttaaagcaattctcctgccttggcccctggagtagctgagattacaggcatgtgccaccacacccagctaatttttgtgtttttagtagagacggggtttctccatgttggtcaggctggcctcaaactcctgacctcaggtgatctgcctgccttggcctcccaaggtgttgggattacgggcatgagccactgcgtcaggcctattgtttttcctacgtaccgtgattgcttgctttcttctctgtcgatgtccctgccatctaaatgctgagtccccttgtctacattttgaggctcttctattatggaagagggctagagaggccatcagaatttggtttcactagcctttgatccttcctgtttaaggagctcarcatttagcttcacttccctgtcattcatcagaattcattctcagattggaattgtccagtcttagagtgatttttgtccccagtgacacttcccttatatccgtgctgacacaggttcaggagaccaggtcgagtcgaaatcctggctgttccgctttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctgacgcctggaatcccagcactttgggaggcagaggctggcagatcacgaggtcaggagatggagaccatcctggctaacacagtgaaaccccgtctctactaaaaatacaaaaaaaattagccaggcatggtggtgggcctgtagtctcagctactcgggaggctgaggcaggagaatggtgtgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcccccttagtagctgggactacaggcacaccccaccctgcaggggttttttttttttgtttttttgtttttttgtttttttttttgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtgstcagctagaaggtcagttaacacatgggatgggaattcttgccaatgtccttcgtaaaagaagaacttctccttcactcacatgtcctgatacttcctcagcatttcattctagcctttctgtctccatccaccatctatcaatcatctatcatctagctatctatcgatttctcttttttggctttaattttgtcactttttcttctgtctgctatagaaatagcaaattttcttatgtaagaaaactctgaacgcgaggccaaagtagaattttccctgaaacagctaccttttccttgaaattgttctatatctaaaatcactaggtgaggagtaatagaaatgtagacatgagaagtgaaactgttttttttccttgtaaaagcttcattgtgccctttagaggataactctgtagtttgatatgataaaaataattatatgattatgctgagtgaggtggctcaagcctgtaatcccagcacttggggaggccaaggccggcggatcacttgaggttaggagttcgagaccagcccggccaacatggtgagacccccatctctgctacagatataaaaattggctgggcatggtggggtgcagctgtaatcccagctgctcaggaggctgaggcaggcgaatcgcttgaacccsggaagcagaggttgtagtgagctgagatcatgccactgtactccagcctgggtgacagagcaagactgtctcaaaaargaataaaaatgaataaaaattatgtgattagagaggggaaaacaatcatttcttgtgcgctaatgccactcagcaggtgcttacactgtctggttcatccttacaatgactccatgttatcgccattttcagatgggtaactcaggtagaaatatgattccattagtttaaaaaaaaatacatagaagataagaaaaatcaccaaaaattcccagccacagtagatgtatctgtatttaactactctcctcgtgttgaatatttatcaggtttctcgttttcttttgtttttgttgtaagtggcactgcaggccagttgcggtcactcaaacctgtaatcccagcactttgggaggctgaggtgggcggatcacttgaggtcaggagtttaagattagcctggcccacatggtgaaaccctgtctctactgaaaataaaaaaaaaatcaggcatgttagcatgcacctgtggtcccagctacttgggaggctgggtcaggagaatcgccttgaacctgggaggtggaggttgcattcagtcgagaccatgctagtgtactccagtctgggcaacagagccacatctccaaaaaggtggcactgcagcaaacagcatccacatgtgtgcacagaatattgttctgttgtgtacctcagatggctttgttaggttagattccctgaagtggaatggccagggaatttaaaaagggttttgctcttgtcacctgggctggggtgcaatggcgtgatcttggctcactgcaacctccgacccccctgggttcaagcgattctcctgcctcaggctcctgagtagctgggattacaggtgcctgccactatgcctgggtaattttggtatttttaatagagatgtggttttgcggtgttggccaggctgttctaaaactcctggcctcaggtgttctgcccgtctcggcctcccaaagtgctgggattataggcctgagccacggtgcctggccaagtctgttttttaaatctggaaaatgggacttgttaacttctgtattgtcttttctgctgctttatccaactttgcaatctataagcttctgttactggaaaatggtgatggtaaagtaattgctttcytatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttattgaacatctaataagacctggacatttggctgaatgctggaagtgcaaagatgaaggaaagttgctttttggaaggatattagaatccaaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacatacataatttctgtaagtactggctattttaaaaattattttaacactattctgatataggaagttaaaaaatagcacagaggggatccctgtgatttttactcacttttctacaagcatgactccttatataactacagtacaggatccaaaccaggaaayatgcctgggtacaatgtgagtgtataattccaggtaggtaaaataatggcccttattaggatgtctgcgtcctaatccgcggaaactatggatatgctttgttacatggaagaggaaaattaagattgcagatgaaattcaagttactgatcctgcgaagttaaaatcaggagattacccagggttatctggttgggcacagtgtaattgccaggattcctaaaagggggagagagagtcggatgagtcaggcagtgagatggcagcatgagaaggacaccgccacacattgctggctttgaaaatggagggaggcgggcatgagccacagaaagtaggcagcctctagaaggtggaaaaggcaatgagatggattctaccgtagagctaccagaagggaacacaccttgctgatgtcgttttactattttcttatttatttttgagacagggttttgctctcgcccaagctggagtgcagtggcgctatcatggctcactgcgatcctcccacctcaacctcctaagtagctgggactacagtgtgtaccatcacgcccggctaacttttttgtatttttagtagaggtggggtttcatcatgttgcccaggctggtctcaaacccctgggctcaagcggtcctccctccttggcctcccaatctgctgagattacaggaccctgctgatgtcttaatcttagccccttcagatcccagttggtcttctgactccagagctataaaagaataaatgtgtgttatttcaagccgtgaatttcttattaatgtgtcacatagcaatggaaaaataaacgttctatgccatttttatcacatgcgtaggttcatttaaccaccgccactactaaaatacaggactgttccatctgcaccgaggtctctctgtgctaccccttgaagtcacacttgccaccctccgcccttagcctttctttcagcctgtgaggaagcaaaacttttactcttcaggcatcacctcacgcgtcttttctgcctgggaggcactttttccagttttcctggcgaaatagtcatcttttaagttctctgacaacccctctctgagcatctaatcccaatcagaattccctcctaatgtaaactctcattatatcttttaactttatttcttagcacttatcatgctgtatggataatggtatatttgggtgagagtatttgtttctctttctccctaagtaggctggaaactgcatgagggcaaaaacttagctttactcaatgttttctcagcttcatgtacgtgactgtatacagagtctgagccgagaaaaccttccttgcatgtacgagcaaatgagagtattcaaggtacagaactgaaattttctctgggtttttaagtggaagagtacacaagcattataagcaattttacctgcatttactcaacagacttttgttttttatccccttcggtgtaggttgtcatactaaattggttcagattctgtatctgggggtagttagacttctgtgaactccaagtagacggttgaacatgactgaacttgcacagtggacacattgtgcatttgtttttaagtccctagctgtttccagaaatagtttggttaattcatactgataaaataaatccccgtaagagcattattccccaaagtgggcttcctttgccaaacctaattatctggagaaggtattgaagaagtcaacttacctcttggccaaatgctttctagaattattcaaccaaagacagcaggctgcacctaggggaagccaaacatctggatgaagaatgaaatatccagatgttttcaagtatctggatgtttctaaccatctgtttctcttggttattgacaaatgatccagctgttttgcagaagatggtataccttgcctaacagaagagagaagtaacattcttagaaaactttgacatcatctcatctgtactaacacaggatttctgtctttaattgaagccatgacttgatcacaaaaatgaaaatagcttcatgtgtttctgaagctgttgtcttgctttgggcgccagactgcacaggattttaggttaattgtcttgtttacaattagagtctgcattgtttgtagcttgattctatttataatgtactcacaccttaaccaatagcctcacagatggcatatgagaatactcatactcagtgctgctaaaaacagcctgctgcctgaacaccagagtgtcttttaaagcgtagaaaagttgggtacataaaatttctgttgcaaaaaggaatgtataggccttaattgaaaatgtatctttctggaacaggagttttagaagctgagtaccacccactcccttgctccacaattctcttttgtttaaggcaacacgtaggttcttagttttttaaatatatatatatatacgtatatatatacgtatatatatgcgtatatatatacgtatatatgcgtatatatatacgtatatatgcgtatatatatacgtatatatacgtatatatgcgtatatatatacgtatatatacgtatatatatatgtgtgtatatatatatataaaaatatatttaaataatgttaaggctagagtagaatgacatcatgggaaggcttattgaaacttggagtggattcgtagtctgccacgagaatccttgtctgatgtttgtgggtgtgtaggactgaatttgaagtccttaaatggatgtcctaacagtgaataaagacgtggggcttgaatttatgtattatcttattactctgtcattttcttgagtggtacaccagagtgcatggaaaagtaaatgattggaagccgcgtggtagttaagggtgatgatgtaggagtgagaacacaggcttggtgcctggcgtcagcacacacatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcaccaggatcaggccaaaggttttcacgcttgtgccttttaaactctcaacaacccagtgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgggagtgtttcaattaaaattatgtatggacatggaaacttgaactttttatgattttcatgatcacaacttactctgatctctttcaaccatttaaaaatatgaaaaccattcttagtttacaagccctacaaacactggcattgggttaggtttggatgatgggccattgcactccagcctgggtgacagaatgagactctgtctcaaaaagaagaaaataaaacaggcgttccttacctacagcctgctatgatttggggttcttgtatttttttttgtttgtttgtttgagacggagtcttgctctgttgcccaggctggagtacagtggcacgatctcagctcactacatctctgcctcccgggttcacgccattctcctgcctcagcctcctgagtaggtgggactacaggcmcccgccaccatgcccggctaatttttttatttttagtagaaacggggtttcaccatgttagccaggatggtctcgatctcctgacctcatgatctgtcagcctcagcctcctaaagtgctgggattacaggcgtgagccactgygcccggccggggatcttgtattaatartagggagacagtaagcaagcaaggctcagttaatgataaattgttatcaggagacccagcagtttctgctttttctaccctcctctttgasctctatttaaactaataggttactgggtttsaacatgccatgcagtgggaagaggcgggaaccccactgagctgtcctctaagtgaatcatgcccactatttggttgtgaggctgtggactttacttttcacgcatggcattgaaagaacagggaagggtggattccccatctcctcttcctctttggaatcaggaaaacatgtttctattctaaatgttctttgataaataagattgcatgttcctggctcctgtaacatatattttctttttcctttgtccggcatacttgactaattgtagagctttttgagcctaaaactggataggaacccagtgcatgcactcttaaggactcagaggcctgctcaaggttaagtgcagtatggtctgaataataagcatagatgcccctttactgagcagcagctgggtgctgggcactgtgctaggcatttttggatgcattttcctcctccaacttcactttcccctatgagattatttcctctgtgttagagacaagaaaaatcaatttacaggtagtttaagtgacttgttcaaggctacagtaagcttgaagtggcaaggatgggatttgaacgtctgtctgcttgattccaagaccgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagagggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatgcaaatgtttacaagctctaatcaggagaaatgaaaaatcacatgtctaattttaaatatgttgcctctgatcacaggtgttgttaaaacagctcttttatgactttataaatactcagatttattttgaagcaatgtttcattattcctatactatgattaaatattgagactattgcttttccaattgttctattgcagtatttaatgagtgcaattaaatggaaaaattgcctttttaactggtgatagtccattagtgtctctgtctcttcaggaaagaaaagaagtgaattattagaatgacaaatgaggcaaagttaccaccgtgatggagaggtgcgatttccctccacataatcttcagttagtgatctctgtaagagaatgtttttcaaaaggctaatagagaagtaatgagatcagaaggaggycaacccggccttctccgtttggcagcttgattaatttatttctccttcttggagattgctgcaaggggcttttgtcaccctgtgtttttcatgggactgtaacctgagtgactgctgatatattagccttgcaggcaaggaagcaagtccgttgccctggaatggaaggcataggagttaagggtttgtttgcttttgcaacttgaacacactcattgggagctttggataatgacaacaatgatgatgattttaagagttaatcaaattaaaggctatgaaatgatgcccactgtggatcctgtgcctggtgctcagcacatacaacatcatttcattttcacagcccttgtgacatgatagggctcttttgcagatgaggaaatgcaggctcagagttatctagcattgtacccttaagcagaagggggaggtaggagtgaatctctgtctgcctctaaactcttgagctcccctccagaagtccagggctcttagaaactttgtactcaaccattaaattgttgccattgtgctgaggagcaaggaaactgggatcacacagctagatcacagtgggggaacctgaattatggggatgctcacaaaagggcaaaacacaacggttgctgtcatttgatgctttatgttaagtrtgcatatgctcagttrcagaaacctaaattgctaaattgcaaggctgtatatgatatgccaatttggcatattctgtctttttatattctgccacccctatcatacttatgaaaatgccaggttgtaatcattcactgggagaaacaaggggttgaacattgttatcgcacaaaggaagctgggcctagtaaaggaatgtaaatactaaaatgccagcatcactgttacttactgtgtttatactggatgtattacttaacctctctggctttatttctgcccgccctccccccgccccccccccgcaatgcctcaatctgtggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtaaataagataatttgtttctgccccccaaaagattaaaatatagatttttttcaaagtctgtttttttaacacctacggtccctgaatatgttcgattgaggtttgtgtctgtaatttggaacggctttttgttgcaactaaaatattcatttgcagaaattatcactgagggtgttagcttctttatgcttgcgtttcttgcatttgttactaaataaaatatttagaagtcacgtcgattttcaaaatgatagttaaggatgaaggtaatattggcatatttatttttatctgtgtaatttttgcaacttataaccccttcaggtccaaatgaaacaggcaaccaggtaataaaccaattacgttctaatacagattacttcatgacagtgtcttattttccagtttatatgtaggtgagattctttggagaccgtcttcgtaatatagctagtttttgtccattcattttgctttgacttccttgtataggtacaaaggtgtaagtaggagagtctaccaggcagcacacagaygtggccctgtaaccacccttgtgtaaaatcagagtaatcctccctatccttgcttatttcactgggttcatgggtgatgactgtaaatgacacaggagacagggaaagagttttgttatcctgatacacacattcttaaatgcctctagctgtgtagacattggtttgtccatattaatagtatttyacgaagtgccagttgtgtgcctgctttgtggcatatgcattggcattcattgctttatttaattcttccaacaacgtgtcagatgtctgttcaaattattcccccctttacagacacagaaactaagatttagagaggttatgcaatgtgccaacagggagaagttggagctggaatttgaaccaggctggctgactccaaagctgtgtcctcaagcagtacatcagagccgaggaaggtcaagtttggaacgccatttagctgctctcagggagtctgattactgtttctctgttgaggctcagctcaagccttccctgggccatgaaagacaacttaggtttgggtgtcctgtgtttgtaccttgttttgtgcccacctacatcctgggttatgtctttccccaccccaagccttttttgccatctctttttcccagaaagactggaaacttgcctaaagagacagaatcccagatcccagatggatctactattttagaatctctgcttccgcatttctaaaatccttcccagagaattatttgactagttaaagcttaagaaacaccccagtggattatgagtgccttctagccaagaatgggtatttcctctgtgcaatctgagggcccgggacactcctccagcggagtagcctgtgatttgtatgggctgcatgaattcctgcactaacaaggtaaaagaaggatgttaaagaaaacccgagatcttttgggtacatgctataaggtgaaaggcttatttccatttgctcaagaacaaacatccatttgtccaccccaagtatttatatagttcaattaagcgggcaggtaaactgattttttgggtggttaatgatctgatgattttcctctctgtcattgtgattggatatgataatctgagagttgcccaaattagtgcctttactgtagttataataatgtcatgatgactgaggatcactgagtgtgccttttgctctgttaagtgtgcattcagaactttactaacatgggttccacaggaaatattagccccattttgcaaatgaagaggctgaggctcagaaatttaaaattgcttcatgtcgcacagttcagtgtaaagttgcaatgcaaactaagatgtttctgttgcttataatcttaactataataatcataaaccatgttctgttgctcagaacccttgtacttataatataaaacaatctttttaaccaagattcttcgcttgggtattctgagtagcatggaagagcattatactttttttttttttttttttttttgagacagagtctagctctgtcacccaggcctggagtgcagtggtgtgatctcggcacactgcaaccttcgcctcccaggttcaggcgattctcctgcctcagcctcctgggtagctgggactacgggagcatactaccacacccaggtaatttttcatttttggtagagacggcgtttcaccgtgttggccaggcttgtctcaacccctgagctcaggtgatccgcctgccttggcctgccaaagtgctgggattacagacatgagccaccaaacctggtcaattttctatggggtgtgttacattttttaaaattttattttactgtttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttsatacacatgaaataaaatttcaaatggttcctctgttcmgcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctcyccctcttcttctcttttagaaaccttgctgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcstaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttamatagctaactaaacaaaatgctaacccatatgggagaaatttccaaagaattaaaaccacccaccaggaaaatgggaaagtctcccctccacacacacacacacgcrcrcrcgcacacacacacacacacacacacacacacacaaaatcaccaaatcacacctgaacaagaggaagaaaattaaactcattgaggagataccatcttttttaaaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttatggggtggggcctgcagtctgacgtttattttttctaaaactttaagttycagggtacatgtgtaagatgtgcaagtttgttacataggtaatcatctgccacggtggtttgctgcagagatcaacttatcrcctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgaytgcagcagttttcacagtagaaaagacatggaattcacccaatccgaattttaacaagtcttccatgtgattctgagacagactcatgttcgtgtggttctggctctgcagaactgaggtgggccccaaaacttgmgtttctaaaaggtactagctgagcatgatgactcacatttgtaatcccaccactttgtgaggccgaggcsggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaaaagcctacagttgacaggcagataacagagggagcaaaggagtcttgtggaagacaatagggagtgttgaggacctgtcaaacaacacagtccccatctgtactttgggagggaaggacttcttaattccagctgcctgttgccatgggggaacatagacccagaactgccatcytttctaatttttttaaaaattaaaaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctragtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtaactggtaactcataaatttttaaacactctgcagttcaaagaaaacatgtttgtggtaggtagycagtttataacctgtgtaagactgtgttattagcaaatccctcaatgtgttgaccaagagtgggtaggaatcctgcagacagaatcttttgaaggtggtttgtttttttattcctttataagtacwgttgtagatttacaaagtaattgagtatatagtacataaggtcttgtgtacccaccgatcgcaattgagcatatagtacatgctgtcctgtgtacccactgatccctggtcctgcccctggtatgagggtattaacatyttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacstcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacacccaaacacccttcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagarattctgtagtttccacaagtaaccagagaattgttcatggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaarttagtcaggtatgtctattaaatttttacgtaaaaagttaaagcagccctcagcatcaacttyttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttwtttttgtttaaattgttataaataagtaagtgtatgcaccactatgccatgtagcatatcaagattatttttctttcctgcaccttatwttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgyagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggnnnnnnnnnnnnnnnnnnnnnnntttccatggatgatgttactcttttaactctctgatgttaatgataaattgttttaatttttcttttctgtttagtttctatcttctcaaaattgttttcatttgttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcacccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaattttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttagaggggacctttctggggtcttttagtcagggtacataagtgtcagctgctacgacaaacaacttgcaacgtctcattatcttcatacaacaaacgctgatttgttcctttcattacatayccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagsccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactrtcattctgccatcaacaccgaggtgtcggagtagcagkagagccacatatttcttagtgaggggacccagaatgatcccttttgtgctagaggatctgagttcatttcatgaaactgaagcatcttcttggagmtataagctcaccttgggatrggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgrcaccatgactctgytttctgggtgtcctctgtgggctctcagcagtgtccccgatgtggagggtcttcttaytctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaycatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgytctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattggcctggatgtcgttttctcataaagttgactatggctattggtggtactagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggtgttggagaccagcctgagccccatggcaaaaccccaaaaaaaaaaaaaaaaaaaaaaaaaaaaattttagtcgggtgtaatggcacacctgtagtcccatctactcgggaggctgaggtgggaagtttgactgaacctgggaagtcaaggctacagtgagctgtgatcctgtctctacacctcagtctgggtggcagagcaagaccctgtctcaaaaaaaaaaaaaaaaaaaaaaaagtaaaataawgcatgggaagtcccttatacagtttgtgatatgggtacacactcagtgaaatggccattaatactgctgttcttaactctgaaarcagagtgggccatttgaatgctcactttgatattttttaaaggaaaaatttgaggcattgacacatgccttttgcttactygcttggattggtttgatcaactttgttgcggtctaatttatgtawaataaattgcatccatttaaatatacaattcaatgagttttgacagatgcacatgcccatgaaaccaacacgaaaataaaaaaaawagaacatttacgtcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggaatggaatgggcaagggtggtccgtatagggctatgtataactttttaagaggttggcaaatacttccctaaagtggtcatcccattttacattcttgccaacagtgtttaaggatccacttcctctacatccttaataatacttgatattatcggtcttctaaattttctgtttgggtacatagtggtattttgttgtatatttttttttaattgtgaaatatgtgactatgatgagtaatgattttgaacatgaaaactatgcttattgctcatatctatgttattttattatttactttttttgagatggagtctcgttctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgggtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtccagttccaagtatctgtccatggtgttggtcccakgttattcgcacctcatatgtctttggcacagcactcttgacagctcataaagtcacgctgttacccccacaatgtccccccacatatcattgctatccctcctcgacacccacacctcytgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttstacatatcttaaaagtggattcctcataaaacaatatggactatggtcttattctstttaacggtatgaaagctcgcctgaaaggccaagagtaagattcttttaaaatcatgcccaagttttaaaggaatataaaactttctctttaaaaatatacctttctgctttcatcccytaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagccyagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggaggaaaaagatcatagagccaaagagctcgatacatatactgatgcggtgtttattttattttagttttttgagacagggtctctgtcgctcaggctggattgagtgcagtgaatcttggctcactgtagcttctgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaayacaagagaaatataagagaaagaaagacttgtatctgttgttagtgagtttttgtggtgrtgatacattaatggaggcaacagagggtcagaaatcagggaaatcagggtggaaaatagcccagcagaggggaaaagaggaagtctgaacgagggccacattgcagatagaggcyggtgtactggtctgctcaggctgccataacaaaataccacaggctggatgacttgaacaacaaaaatacattttctcatagttgtggagcctagaattccaaggtcaaggtgccggcacagttgatgtcttctgaggtctccctcgtctgcttgcagacagccgccttcccaccgtgttctcacgtgacctagccgctgtgtgcatgcatccctggtttcttttcctgtgttcagatgtcctcttctttgaaggacaccactcagtattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccatttatccatggattggtatgagccctaatggtgcacccttccgacaatccttcatccttcccagacgtttcatcagccaagtgaaatttgcaattgtttcagtgattgaaattatgcttggagtgcaggtgtcatggatgaaacagcaatgccttgcggtgacaaattcagtgtagaaataattttagcaagcccagtgattggaaaacaatgactcaactttaagctatattgattttgtatttctgggctcagcttttgactcagtctcattccccagaaataatccctgttaacatttcggtttgtgttatggaagtgttttctcttctatgaattagctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaaatgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctygatccttacacttagcatcatgttttcaagggtcattcatgttgtagcatgtatcagtacttctttttttagggctgagtaatattccatttacggatatgccacatttcatctatgcattcagttcayggacatgtgggttgtttccacattttggctattgtgcataatgcttccaggtacacttgtctacacatttttgtgtggatataggttttccttttttggggtatgctcctaagagtgcaatttctggatcacggggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactgtggccatgaaaccttgcctggcccccagggatggggtgaggggggatatcatatatgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcttggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgyatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcrgcctaygcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcawtgttagtgacttagaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgsgataatctgcctrtttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtcttatttattttatgtccttggagtgtatagcagagttagatagatctttctggattggcggttgattgaatattggctgtacaaagaaactggttaggagtatagagaaaagatcaatcatagcactagcttatagtttattttattctttaatgattttttaaaaatatttctctcacttacttgaaaagcagtcttagaaattaactggaatgggtaatttatttgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattgggattaagggaaaatcaagtaaatcgagaggtaaagcactgtgcagaaatattggccagaagctatgaacagttgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaactgaacatctgtctaattgttcacctccatcgctttagtgctttcctcatgctttctctctttccagacaataaactttattttcttcataagaattcagtctacgcaagggtattaggcagcttgtttgcaccttttaattgctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccctccacccctgccagaaataaagggattaatctctttttgcttggcatagggagaagacagtgtctgctgatgtgcttaactttttttttttttttttttttggtcaggtgcgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttaggaatatccagcaagccacttttaaaggctttttatcacattttattcttaagctttctgaattccttattatattttgcctgataaatagttggattttgttttttggttcaatgtaagaatattcttaaactaggtaaactgttttaattgtttgtcattatgttctctcattctgttaaattttgttttctatttttcatgtttttgggtttttctagatggcctgtctttaacacttcttgatatttttgattaaattttcatatatcatcaaaaatagagatgacagccaggggtggtggtgcatgcctataatcccaacacttttggaggccaaggtgaggagaccacctgaggtcaggaattcaagactactgggcaacatggtraagctctstctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaacccctttttttctctgaagtcattgctccggtgtgtgtgtgtctgtatataaaaaaaagtatgtatacatayacgtatatgtatgtgtatagataaaaatgcatgtatggtgctgggcgcagtggctcacgcytgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccsaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaataactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggatagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgargcaggagaatttctkgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctaggttctgttgagacctgactttgggaatagcataggtacttatctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccggtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgttattgtaaaagcatcatgcaccaggtaaaatgtttaataacacagagaaatctaattgtcaagtatcttctcaacacacattaatcaacaattctcmtatcgaaggataacctcttgtatttacaaaaaaaagaagaaaaagtgctgtcatcagtaaattcattcatgtatgttatacacttacatacaaaatgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattatctgggtgtggtggcacatgcctgtaatcccagctactcaggaagctgaggactgagaatcgcttgaacctgggaagtggagtatgcagtgagccgagatagttctactgcactccagcctgagcaacagagcaagactccgtgtcaaaaaataaataatatatgtgtgtgtgtgtgtatgtacatgaattatatacaaatgagggaaaatatacaaatgagttgaatatatacaaatgagggaaaaattgttccttgtgtcaggaacaattactgtgaattttgtgtagcttttcctgactttttaaaattcaaatatatttcataaagttgaaatcacactgtggtctttttttttttttttttttttttaaccaaacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctggggctaaataagaagtttaaatgcaaatagataattcttgagaaagcttcttccctgtatatactctttctgcagcagtgtctgagtgtctgtaccttcctataccttcaccatatcatgtatttgtcattttatagtgagttgtattacttgctaggtgagctggtatctcctttgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctgggagaggtgactatggacttaattttgctttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcaccagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaaaaaaaaaaaagttgcagaaatagcaatatttaactatacttgttactcaaatttcaccactaaagcagtgtcatctttttattccaggatctagtccaggatgccacattatatttaattgttgtatctccttggtgcctttagtacttttttttttgagacacggtctcactctgtcacccaggctggagcacagtggtacaatcatgggttactgcaacctccacctcctaggctcaagcgatcctcccacctcagtctcctgagtacctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacagacatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcttgtcgcccaggctggagtgtaatggtgcgatatcggctccctgcaacctctgcctcccgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaaagtgctgggattacaggtgtgagctacagcgcctggcccctcccccgtttatttctgattcaattactttatattagcgtagattcacaggtatttcctttttttttttttttttgatttattaatacctccatttattctgttgctgaaaccattccagctttttctggttggcttctatgaaggacgctattttaatggggtgatttttttcttctcactacattcttgctcactccccactttttatgtccggtggccataggctggtgagaacttgattttgaacagttgaaggtctgctgttagggacgtgctaatctagggaattgtactgaactcgtgggagcatgttagtatcagatgtgtgccttgtccgtcttgcttgtaggaagaacaagagacgagacacagcaaggtgatgatgggtatgtgaagcaggataaagaaaaaaacaggacaggcattacaggcttaagyctgtaatcccagcactttggaaggccaatgcgggtggatcacctgatgataggagttcaagaccagcctcaccaacatggtgaaaccctatccctattaaaaatacaaaaattaacaggcgtggtggcgggcatctgttgttccaggtactcgggaggctgaggcagcagaattgcctgaactcgggaggtggaggtagcagtgagctgagatggcaccactgcactccagcctgggcaatggagcaagactctatctaccmcccaccctgcaaaaaaagaaaagaaaggaaaaaaaatcytggtgcttgtaggagaggcatttatttcttttaggactggacggggcttggagggtttccaggaaacagcctcaacctaaaaatagtagacacagttcatgaagaacttactatgtgtccagtagataaatataccacaagcattatcttctttaatcatctcacaatcttatgaaggagatactaatattttgcttgcaaagatgagggaagtgagtttccgaagttgctaartgcgtaaaggaggtggtggtgtcagaatgttatcctgctcagatggttgcatgggacagtgtccagaggaaggcctctgattccttccccagcattaggcaatattcaagtcttcagttccatgtgtaggggagaagactttccttctgctccctaatgacagtggtacccacacccgtattccaccataaaatcttttttattcagtattaggaaaaaagaaacatctttccgtccagtggtcactgtgtgtgtatgtgtttgtgtgtgtgtgtgtgtatgtgtctgtgtgttcaccgtgctgtgtgaattgtggctttaaatgtattcctgtcaattccatatatttttaaaatgttgcttttagagtatgtgcaagtttggggcatttttgagggcttttttttttgacggggtcttaatatgtcacccaggctgtagtgcagtggcgcgatgacagcccactccagccccaaactcccaagctccagtgattttccttcctcagaccccaaagtagctgggaccacaggtgcacaccaccacttccagctgattatttaaaaaaaattttgtagtgacagtgtcttgctgtgtttcccaggctgttcttgtactcctgggctcaactgatcttcccagcttggcctcccaaagtgctgggaatacaggtgtgagccactgtcccaggccagttttaactcacaatgatttcataagaaatccacatctgagagtcccagaaggtaagatattcccctttcttctaaatatacttgaccaccaccattcaggttcttctattaaccctcctatatttgccaaccctcaacctgttagaaacaagaattgggactctggagtagatgttagcaacatcatgagctcaaacccctccagcttacagcggagacagtgaggtcctgtaggatgaggttggagagcaggaacttgccccgaggtcatgtgcagagttcgaggcagggcctggatgggaagcccagcatggagaccccaggccgtctctccgccatcttgttgtgatgcttccggaagaatgcctgtcactcttgctgacatccgactgaccaagtgggcaagaggaattcttcaaaacaatttaataaatgcttacattttctcttggccccgtgccacatccccccactcagtcttgttttcaaggttgaaggttccttcagagctagtgaccttgcccttcctggcctgtggatgtcgctctctatccgtaaccctcctttccagcgaccctgtttgcagcaaagactataattttattttgggtttggatatactgattacattttagcttctggtatattttcttacctgtcacagccattaaatttattttaatagttactctactctcctgatagccactaaagggggaattggatattgtctatcaattggttggtctctgaactaaggctgtatctaattacaaggcattgtatcggttstgatttattaaccatttacttggctttggagaaggcagcatttttagtagtactgttgagcctgcatgtagcttttccaggagggcagggtgccyggatatctgatcttacagttattactttgtgtcatatataattttgttttctccctgcaacaaataaatctttgggactccggaagaaaaaaaaatgggaaagaaaaaaaaaatttgtggttacagtataataaaaataaactgtttgtcgtgactgcagctgacatttatcagcctgtttgtgggtgatctttctctctctctataatacagaacataatttgtcactttgtaaatacattccagtctaaatccctgccagcatctgttagtgtttgaaggattaatgtgctaccctgtgtatgtctgcacttccagggaacagtgtagcatctgattacagatcktgggagagcaggagggaacaaggtgttttctgtgctttttcctacatgcagtcgttttggcctttttctgatttttcttgtctttatcccattctgtctaggtacctggaatttcattctttacaaagatgttcctggtccccaacctttcttctgtctgtgatagtcacagctgaagtcatagtattttctgtgtactatgggttgagctgtgggtaattctttggggccggttagacttgggttcaaattctttctccaactagtttatgagcttaagttatgtgatttccatttcttcacttgcaaaatgaagatgctaatacctacttcttgaagatgctgaggttgagggaagaaataaatgttaatgcaaagtgcccagtttagtgcctgccaagagtaactggtgggtctgtgtcaccttctgacatkatcagtgtgattgtctccaacgcatcyatggaagtgaaaccgttggaggaagctaatgccgtgagccagctgttggttatgtttttgttttgtttttcttttttacttgctggatagtgggttctgtttattgagaaatatttacatccgtctaawtcaggtgcttgctagggttcttggcacacagagcatcccaccaataaactgtggttcccaacaaggcttgcaactgaatctgggcaacaatgaacatgacttcaataatgacaaaaagattcagattcctgctggaaggtccatatgtgctgtccccagtaggattctggaattccctgaatcatagtgttgcttgtaattctttccacattatgaagtggctctatagactgcctaccaccttgtatctactgctgtcgtttagattaggaacagattgccagatgtggaagaaatagcctcattagtaacttttctgtaagcaatctccttatttcttkttttttgttcttttgttttttgtgtgtgcttctgcgtgcmcctcctctatggctccccccaccaaatttctgtgtcttcatttgcaactctcttttctccagtaaagaggaaagtgtatagttctcctttccttacagaaacattattttgttattgttgtttgggtttgggtttctgaagtataaatgcatatgaactggacagaaggattatgcccatgtgccaggtggccaagatggggcttgtgatttgaagcttcttttcctagattcaggaaagtatcactggttaatcagggaatacatctttcggcccattggaaaatgtctgttcttagcaccctaaatgcccaggtattagcatacttgggaaatgtctagaaacccctatttcaatttactgaccatttttggtaaattcctagagatgccaaaatgcatttcaaaaagctttcatgttcaagaagacttgtggaatgatagaaaacatttaacgctgttatgtacgaagtgaaatactgttaaacttttagattatttaatagaagacacattttacaaggcaaagtgtttagatatgctccctcctatgcctatccacacatccttaactcttcacgttgtttgagactgttaggctgtttttttattgtatatttcatcaaatagtgggtgataaaacaacagacactctaaggaatggcatgacattctcctttcttctcctgcattcattggaacctgaatgtagtattaattataagactgttagacttcaggggactacmctcttattctaaaatagtggtcaactaactgtgcccttcagacagaattcctgcccagcacctggctttgtaattaaagttttactggaacagaggaataccagttaatttatatctcgtctgttgccacttttgctttcatgctattaaagctgagtatttgggagatacttgaaaaatctaaaatgcttmctatctggccctttagagaaaaggttttccaatctctgttctagaggattcgtggtcatttggaaagaaaagtatgttaagacaaaatgagcaggtggttggattagtattttctttctacacatatagaaactgttcctatcatacctgactcagttttcaaactkgcttaatccaaagcctggggggtggatgtaggagagaagttgaaattagctggggttttttttttgtatcacaaaagttacattttttttttttttttttttttttaagacgtagtcttgctctgttgcccaggctggagtgcagtggtgtgatttcggctcacagcaagctctgcctcccaggtttacgccattctcctgcctcagcctcctaagtagctggtactacaggtgcctgccaccacgcccggctaattttttatatttttagtagagacagggtttcaccatgttagccactttggtctcaatctmctgacctcgtgattcaactgcctcgccctcccaaagtgctgggattacaggcgtgagccaccgcacccagccgaaaagttataattttaatggtctaaatcaaatttgttcaacctgcagcctgtgggcacatgtggcccaggacagctttgcagcccaacacaaatgtataaacttgcttaaaacatgatgagatattttttgccattttttttcaactcatcagctatcattagggttagtgtattaataytttatgcacagcccaagataattctttgtccagtgtcacccagggaagccaaaagattggacaccctgggaataaaacagaaaaaaggtgtaaaaggcttcgagttcatggacagaacaacatttttgtaagtaaagtatttacggatgtggcccctttgtaatctcctgggctcagggataatttccaggctggggagaaggttgtgtcatggagacagcagtactgttttggaaggagaattgacttgtcacaatggacggagaactaccatcccatttgggccaacctcttttttttttttctttttgtttcgagatggagtctcgctctgtcaccaggctggagtgcagyggtgcaatctcagctcactgcaacctctgcctcccgagttcaagctattcttctgtctcagcctcctgagtagctgtgattacaggtgcgtgacaccacaccccgctaatttttgtatttttagtggagacgggatttcaccatgttggtcaggctggtgtcaaactcctgatcttaggtgatctgcctgcctcagcctcccaaagtgctgggattacaggtgtgagcctctgtgcccggcttctgccagcttctcattatgatttttgagcagatttcgctgctttttcggcctttgttgtgtttataaactagaagtaattatgtcaactttgtaagggctcagtagcgtagaataaggccatgtctgtaatctccccttctgtgaacagaggttatgttctcaaaagccttcaattaacatgagtggaatggattttctaaatttatatggaggagaaagttgtaggtcctatatgagtgatgacaggtgatacttaagttaactggaacatatggcccttagccacaatttccccacatgcccttctgggggatgctttgtagacctgatatcccagaaaggagtgtggactcataaagtcactgctgtcctttggttttcctgatgtaccaaatgtagtaaggcctcttttcaatgtggtaaaagctctgggccaccccataaggctgcaagcgctagaagctcttcccatagagaacatctatatcctcaaaccaaggagaaaaaggaagctgctgttcataaatattgaagaggcagggagagcttgcactgaggccagggtgtattaacatgcatgccatcgtgaagtggcttctaatggacatttgtaaggtggtgtcccctcccttcccctcccccctctaatgctgcctgggttgctctttgcaacacgtgcagtctgcaacttagctggcttttagcaaaattacccatcgcgattcatttgtcccattgggccatgggataggtgactacagagccagattcgaatgtggccctgtgccggtgcccaaaccagcaggctgcacgtatgcactgacagaatggtacatcccaccactgctctgtgtctgtgtgcgactgtcagctgctctctactgctcctcatagacttcctgtctgcctttttctgcatttctcagtctccccatctccccttcttatctaatccccttccttcctctctcaactcttccttcctctatcctttttctttcccttttttttttaactattcttctttagagtttgttttctcattgaacttgtgatgtacacattaaaggaaaactcattaatgtggaaaattaggagcatcatagctaatgtatgctcagggcttactgtgtgctagacattattctgagtttacacagtgatgtcagatttctcctctgtcacagtaagttccaaaagatagtgaagaatattgcagtgaaaacactgaaactcacatatttcatactcaggggtatcttttaagtgtgaagcaagagaaaaaaacgtggaaaaaaaaagactcaggaaatgctttccatttagctttcttgactaagttagtggaagacttattccagattataaagagaagaaccaaaataaagagtttaagaatgaaggggtatgcagcaactggtagggtcgagtctcctcaggcacaacatgcaaccaaggaggggcagctcactcggcctgcgctggccacacaagtgcacctgccacagtattgaggggctggactgatttctcattaatgtctgggcaaaactcaaagaggcaaacattttcattacatactgttatccatcctattgtgggaccaatttctccagaaaggtctctctcggtgggaggattaataaacaccatcagaaatccaattaaacccaattgttaaaatccaacaaatacgttgcttgtggatacagttgtgtatagtaatgtgtatggtgatggcctatcatataggaatgatagaggcagcacagtgctgtaatggaaaccataagggcacgcacaatggctcatgcctgtaatcccagcactttgggaggcmgaggcgggaggatcacataagaccaggagtttgagaccagcctggccaacatggtgaaaccccatctctactaaaactacaaaaatagccaggtgtcctggtgcatgtctgtaatyccagctacctgggaggctgaagcatcagaatcgcttcagcttgggagctggagcttgcagccagccaagatcacaccactgctctctatcctgggagacagagcaagactgtctccaaaaaaaaaaaaaaaaaaaaaaagggcatggatctagatgccagacaatctgggtgcatatctttgctccaaaagcaaagattgtaaactgtctttacaatctggggcaagttagctaatctctgcttcagtttgctccttagcaagatgggatgatattaccacttacctcagagagttgttaaatgggtaaattcatatgtaagtgttcttagagcagagttcagtacatagtaagtactgtgtaagaattggccatcattaatattattcattggataaatatcaaattcaaaataccgtttacattgggaaagggaaaaaggagagaaatatatgagagacgtatgctgggggtatctacgatgttttctttttgatttttttatgtcattttaaatgtttctattcttctgttctgttcttaaagtatgcctgtaattattaggatataattaaggattctgtcttatttattttttaatcttcttactgtgtctatcttttgtctttctccatattctgggagaaacatctaagtttccattccttataactgattatttttcttgggatcaattctggtcttcaccatctgccaatgtgagttttagtttctctataaacttttaaactttaaactttttttcttttttttttgggggggggggcaatccattcttaacccccttccagtttttctcagcctattcttgtttgtttttgttttctatttctgtttcattgagatgcatacaaaatggaagatggccaacatttctaaaaattttgtttcctgacatagagaacgtttagaggtcaggttgctctgagactgtgttgtgatgtcttttttttttttttttttttacttgtttgtcctttcttttattatctcttgctgttatcctcacttttttctttgctgttcttcatcctttaattagcattcaaactaatcgttattagagtgtgtaacatgatctttgacatacctaggtaattttacttaagtatatgagttatgttgatacgcacagttcctcagcatgaatgtcattgttttgcaaattttagctgaaggtgacatcactgtactaaaattttcttgtgcatccacttcctagctatgactctctacagatggatataacttttttaagatgaaaaccatttattttcaatttctagtttaactgcctcacagtaaaaaagtgtactttttgtgatggcaggaatttgaagtatgttgaaactgcctttgtgatctggctcatggttaacttcaataacgtatgaaaagaatccatatttttatgtgtagtgttctgtagctcttttagttggtttatactcttttaatggtctgttgaccattttatctaaatattccattttgtcttttacttatttctattataaatggttaatctcttctactaagattgttaaatccatctttttgtttatggctgtgttatttggcacatgcaagttcatgattgttatatattcttgcttaattatttttccctttatgcatcatccatttttatctttagtgtttagtgttttttatttttattttgcctaaaattttatttttatgttaatatttgctatactagctattctgctttcaaaatgttcctgatgtttttctttatctttatcatttatcttttatctttaacatttttatatttctctcttttaatcatgtgtgttaggtaggcaaggatagctgctaggacaaaatattttctgatgttttaatagcttaacacaatggtaatttatttccagcttatgtaacagtgcttattgggcgctcagttgaggctggaaatagacatgtgagtgttttatggactaggccttgaagaagtgtacctcccttagatttatattccactggccaactctaagtctcacggctatgcctaattgtgaaggagactgggcaatgaatctagttgagtgccctgcaaactaaggcacagggatttttgtgaacagctggtagtctccattacagttctcacatctggacaacaagtaccttttgctcccttattctcacacagagaacatattcacttttcttccaaaggcagagtctcaaaatcccatttaattctttgattctgtgcaaattctagggtctccttcatgcttagatatggttccttatggtcctgtgggtttcagaaaggcagcccattcatgccgtctacccccctgctgctctatataatagaaggtggagtagagacagaatatcagtagcaaaatctccattttcaaaagaaaagaatgagaaacatgttgctccatgacagtcaatgatagaatcacgctggggaggtaaagaaccttgtagtaagagagcattctttatccaggtctgaaatctgctctctggagggaagtgccctgtccattatcctccatggtcccatctgaactggatctagagaagggttactctccttagggaaattagcagctgtcagcccacttcctgctggtgcatggttgaggctccgtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgtaaaagcagcgtggagcagccagcacacaatgccattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctatgctgtggaaagaggagaagtattctgagggacagctagttctatctgcagtgtatcttttttaaacagcatagaactattttttttttttaattctagtcttggtttctgcctttcaatgtgtgaatttaagttcatgtttcttttgatgactgataaatttgaaataatttctgtatttcattgtgttttcttcactaccaagtttttcttatttttaaacttttctgagcatatatatgtatattttttgagacagagtctcagtgtcacccaggctggaatgcagtggcttgatctcggctcactgcaaactctgcctcctgagttcaagcaatcctcccacctcagcctcccaagtagctgcattaaatacgtgtgccaccaggcccggccaatttttgtatttttagtagagatggaatttcaccatgttggccaggctggtcttgaactcctgacctcaagtggtctgcccgccttggcctcccacagtgtggggattataggcgtgagccattatgcctggccaccaggcatattttggaattgatagaatttctttttatctgagttactccatacatcattttttctccctgttgctcatttggaagctaatgattctttcctccctttcttcctttctgtctttctctgttttcctctctccctgttagtcttgaaagtcttacgtacatgtttaaattttttcttagagtatcaagttatttaatgtctatcattctaatcaacaaagccagaccatgcatgatttaatggatcagtgaaatccttccccccataaaacaaacttcacttgttagtgttgttttagttgcttcttaaattcattttcagtataatttatttggtcctgtagctactccaaatgacgcacaaaatttggctaaactgatgactctttttgtgtttatggtgttttgagtcctcaactttttctgtcttgaatttttttttttttttttttttttttaaggcagagtttctgtctgtcgcccaggctggagtgcagtggcgcgatcttggctcactgcaagctccgcctcctcggttcatgccattctcctgcctcagcctcccgagtagctggaactacaggtgcccgccaccaggcctggctaattttttttgtattattagtagagatggggtttcaccgtgttagccaggatggtcttgatctcctgwccttgtggtycgtctgcctcggcctcccaaagtgctaagattacaggcacgagtctccgcacccggccctgtttttgcatttttagtagagacgggttttcaccaggttggccagcctggtctcaaactgttgaccttaggtgatctgcctacctcsgcctcccaaagtgctgggataacaggcgtgagcmactgcgcctgtctacattttctgtctttactggtattatggygggaacccataaaccactgcgaggcagataccattttaagcaggaaaccttatttttttcygaagcacatttaaaaatattttccagtttatctattaaacatcctcctttgcttctggagatcctctgaaagatttatctctttcgattcatctgtaaagtaaaaataaccgtcgtcgtcatttctcaagcgtgacgatactgttacacgtttactgcatattstgcataccaagcacatatccgtcacaygcagtgtggccaacttccgagaggccggcattcagccaaacagcctgaagaaccaggagaaatgcctgagtttccaaatggcttatggtaagttgttgctgccactatgagtagcctacttgcatttctayttaatggcttttccccatatttgatggtatgttaaacagtcaatcattcattttctaaattaaagcctgtcctgaaaacgtgctcagtgctattgactgtgcatcaggtattagagacacagatatgaaactgtactttttaatttacgataaatgtcagtgtgaattattggttgttttgcttttctttcatagtctccgtaggcttcttgggaatggaaattggtataacctttttggaggaccctcagtaaaaagctatcaaaatttaaaatgtgggtatctcttgacctagtgagtctacttccaggaattcatcttaaagaaaaaaattatagtttcctaagtatttgtattgcagcattgctttcagtggccaacaaaacaaaacaaaacaaaattggaaacaacataaaataatattaccggagaaacaatgagtaacatgtataggattttttttttttttttttgacggagtcttgctctgttgcccaggctccagtgcagtggygtgatgttggctcactgcaactccgcatcctggtttcaagtggttcttctgcctcagccttccaattagcggggactaccagcgcatgtcaccatgcctggctaatttttgtatttttgtagagatggggtttcaccatcatggccaggctgttctcgaactcctgacctcaagtgatccacccgcttcagcctcccaaagtgctgggattacaggcatgagccaccacgcccagccgcttctcgtagatactacccaggaattttcacagtaacttcaaggaagagattgttctgtaatttctgtttttactgataaggaagctcacgcttagagaatgtaagtaaaaagttcacaaagctagtgaagtatgtgggggcggtttttaatgaatgattgaacattctttagtggaactacaatactatgtttttaggaaaagttgcacgatgtttttacatgggtagaaaatatactctggaaggatttgaaccaggctgtccctgttcttatcttggggcagtaggactttggggcacgttttcactttatatgttatcaacttctgtattatttgtaatacaatgaaccagttttatttttgcaactaacagtaagtataaatagctgatgaccacttggggtgaaccgaagtgcctatgacaaaccacacgcaggcatcctcgggactattgaggccagataatcctttgttatgggggctgttctgttcgttgtaagatattgagtagcatccctgacctctgccccctggatgccagttcactttccaacaagttgcaacaagcagaaatgtctgtagatattagcagatgtctgctagcagttagaatggcctctggttgagaatcagagcagactctgctcacactgggctatcagggtatagttctctccctcccaacagctggaactgagaccatctccctccatttgaggatcattccgatttcccaagtccaccgtgtggaatgtaaaatcctttgaaccagaacagacaaatcttgtttttgtctttttattgaatttaaccactattgacttgcgacttgcggcaatcaccagatcccagatctctgtgtttggagctacacgtcyttctgaatcgaggaggtggggcactgatttttcttttatcactgacttccccgaagtgggaagttccagtgcttaacaagtttcattaagaacacagctattaaatattcagaatatacagactgttgctgttgagaatgtaattatgcagtaaattagctgatgtccagtacgttgccttttaagcagatctttgatgtatgcagtacttgcataagatatagggcatgtttattaagagtcttcaactgtgtataaaactagagcagtcaaaagtaatggtgtctgctgaaggattctttatcatatgaatttacctttagtcatctattatttatttcagctattttatatgccattataataaatattatgacagagaaagcttttacgcttcaacttattgtactcctctttacttgcctgcaatccttcaggaaaatgtaaccacgctttacctatagttaacgtaaatcatcacttacattagaatgaaaaattcactatgaaaaaaagctcttacttcaatagcaaggcataaatgcacaatcatgttgactgccaacctcctgtgtcattcactgtccttccttaaactgtttttaagctgcaaagtgaatatattgcatagagggaaataggaaggttttggattattttcgctctcttattagtttctggcaggataagcattttttatccggattgcaaaatattgccaattactgtctaagcatttttaatagttttgctttccatggcacgcaactcatatactaaattaaataagctgttatctggtgcaatttctccttgaatagactcagaattacctatagatattgacacggttattttataaattgagttccagcaacacaaggcaaaaattttggcctgtatgtaatgaaggaagagttgtcatcattttcttattagggatgtttgtgtattttggcagggggaggtaggaaggggacctgatggagggccctggagtgaaggttgatgctggatggttgatttgaaggttaggaatggcaaactcagcctctgttcttcaagaatccccctgcgtccccccgccctgccccctgcccaaaaaaaaggaaatccagggctttgctagggatcatttttggtgtggttctgtattttaaaatgtggaatcatctccaaaagtgtttgtttattaaaagcaaagtgataaaatgtgtcaagtcagtgaagagactctcaaactcccctttcctgcgaatcctatcagaaagaacatttatgagggcatacttttcatctttaggcttggcaaagatgggtcaaactccccatcagactggcacatggtgctgtttcaggtttgactaagagagaaaagaatcactagtcaatgaaagcaactgtgtccccatgcattttcccagtgaagatgcgatcaccccattgccaccgttaccattgcttaaataatattagaggaattagtgttatgaagtcccacatatgatattgatgaattattaaaccagttgagttagatttctattgtagttcagtgaataatgtcatgtcaatactgtgctcaacgccagtgtctcttgctgttgtaaatgtgacagctcctatttaaggttttagaacataaaatcaggactgagagtatgtaaagcggaagggtgagagacatcagcataatgcaattaaggcccattggattagaatttgcaggatgccattagcaataagctctgagtgtagattattgccgtgcttacattttctccttcagcggtaacacttctcttgtaaattctaactgggtaaaataaatatgatataaaacagacacaaataagaatatatagatgatgttaatttcttcagagcttcccggtgttacgtcttcaagaatatgaygacaggggaacagcccagtgtggcagtcatgtgacgacatgagcattggaaccagccacatctcagttggcaacacgtatctgtgtcttactagcttggccactgtcacgtcactcagcctctgttttctmatctgtaaaatggggaaaattatagatgcttcagaagatatttgctatcactattaaatgaaaacaagcatgtcatcagtgcttattatttttgttgcttttatgatcaataaatacatgcaaattagagctttttaaatgagattctggaaataagtttttccgtatgtgtaagggaggggtagatacactgccatccaatcagcatcaatgggtaccttgaagtgagatcacaaaatagctaattccctgtaaacagcaacccttctctctgcagttgcacatgagtagtcccccagttaaaagagaatttcctccagatacaatggaggccacgttcaacacagccatctagtgtacctgggcttcttccacctccagccactgtaccgacgtgttcctttatttcacccacatagtgatgatgcttccaacacagcataacaaagagctgctgctttgtgctgctagatttgccaaaagtctgtgccagggattcttttgttggaggtaagtggagaacgcaaggcccacatgcacaagatgggagtattttgaagcatgctccgtaagacccaacatgtgggcagcagaccaactacttgggttcactatggcgagaaatgggataggagagcgaactcactgataccctcccagctaattcctaggcaatctgcaattaacaatgattgtaaagtaataatttgtggttttgaaaactaggtttgatcactggaattattcctgtcctatgttctaaaggcctgttgccttgagatgttttttctcctcccattattggtaagcataatgtaggcatgagacgttgcctttgaagtgtcggaaggatggagaggagaaaagaaaacggagattgaatctggaaaacgcattcatctttagaggcagtgttaatgaatacatgaatttagtcctgtaaatgttttctcccttatttgggacttggtgtattgaaggtgtctgttaactgtgctaccaatgagtgcccctgtatccgagggaaactggagaagtgtacttgggctaccgggttaccaagagcaggacagcatgaggcagttacagatctgatggtttttcttggtctttgtctcagctgccatgagggcttctaaggggcaaggagggttgggggatgagaggacaggtacatagtgtggacataatggaatatggaatagcaattgaaatcttgcgttgggctgaatcatggctttgcagttattatcttgatgcggctgtgcatgagccttttgaacctcagcttctccatctgtgaaataggtggataatgactgcaccctgcgaagatgctatagggataaataactgctgtggggcaaggactgaaatggttgttgttttgagatggcttttatcattgggccagtgacgacccattcagccctatcagtgaagagtgaagcactgcactctttaaggatagggctgaatggtttatcacccattcagcggtgaccaccacatcttatgcattgtgatgatcacgatgataaaacaatacataatcacaatataaggatctagagttatgaactactgatcaggtatcatgttctgctccaactgctttagatacattgcctgacttcccgatagggcaggtgctgttattactcccacttcacagaggagcaaactaaatatacaagaagcagtaacttgcccagccccaaaccaccccctgaaaaaagaaaacaagggagacccacagttattaatatgcattattattggaaaacaatggtcatcacattttagcagtggccttcaaaataatgataatagcatatattgagagcccattgtgtggcttgtaccttatattcactctatctaatcttcactctaaccatagaaggcaatactattatgctcattcataattaaggcaattgaagcccagacccttccagtagctttcctgaagtcaagttgccagtgcattggacatactrggctgtagttccagggcagcctggctctggtgtctttgctgcaatgacaatatctccccatttctctgtttaaataccacacactccccatatggtttctttggtttcaggcagtatcgcatcagagtcacatatggctaatttatagtcataaaatgatattagagatcactgttgcataacaacaagaaacccctttgattccacacttacagactcttgagtcactaacacaggtttcagtatatataaagaatagatgaagaagacttagtgtattaaggtggcagtgaactgtgctactgatgagtgccactatattcaagggaaatgggagacatgcacctgggttgtttgattatgaccttctggctgagccctggatgttgggagcaagtgggcttctgagctacatagaagttgcctgatgcttcacatgtgggatgccacctgtgtggctctgttttaaaatgatgggtagtagagtctgtatacataatttaaaatacattaacatttctgttttgcctgagataagcttgtactggtgtgatcagaaggaagaatgaggatttggggaaggaaaattttgagagccattttacagcatttcaagattcagtgatctcagaacctcttttggttaaacaagcatgggargatggatgattggatggatggatgaatggataggtaggtgggaagataaatggatagacatataggtaggaaggaatgagggatatatggaaggctagcagtttattttacggtggtgggatttttttcttttccttttttactcagacagtcttgttctgttgcccaggctggagtgcagtggcacgatcatgtctcacggcagcctcgactttccaggttcaagtgatcttcctgccgcagcctcctgtgtagcaggtgcatgctgctatgcccagccagttatattttagatgcttttttatatggcccatattcatatgtctttgtgacttttttttataatggatgtgagtgtgaagtaggagttggcctgaaacaagcccagagaggtagacagggaccaagtcatggactgagttagttgttgttgttcctcactttctgtttttatttctcctctttctggacacatagcacgttgcaccttctagaagctaggcacagccacatgactttgtcaagggaaatgtgagcagaagcaacaccagtcactattaagtgggaagtctttgagatgccacgtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagctgggcgacagagtgagactccatctaaacacacacacacacacacacacacacacacacacacacaaaagcacagggctttgttagcaggcatgacttggattctttaggatccttccctcagtaatctggtctgatgtggccttcagggaggatctttggacatcattgccatccatctgtccactgtgctggactataacccacccagactaccatttattgccaagtggcatcgggacaagagttttacacaagaaacatcttctctgctagttaaattaattagataatttgtcttccagacaggatgttaggaacttatgaacatgtatcgttacaaacctatgagtagatgactaatattcatcttttacagataaggaaactgaggctcaacagtgttaaatggtccagaatgagtgtgttttctagctgtcactgcctgatgtttactgctcaaagcttaggacttggattagagcccaggacttggcagccaagataaaccagstgcaattacgctgaacatctcagcccagctcctgtccatccctgaacaggacacttagggtagaggatgttctcagcagtgccatttgcatcccccttcatagccttacaggtatcatgttatcctccttaatcttacttaagcatcacagtctagactagaattcccaagtcaaccgtttgttttacgggactcttcttatttgaataggcaggtggccctgtgttcttggcttttttgtcctttcaaggagctaggtctaagaagtgatagtatttaatctcgcactccgaagcgcacccagatttaaaagttgggagtggcccatacacagaaggctagtgggaggggcaacccggagatttgtccttgcagaatgatgccatgaagaacatggccaatggaacaccattgcttcaaatcccgacctctccagttctcctggtttcttgttaggcgggaacttgggcttctttatcagtgactggggtcagttcttgtactcaacttcctatctctgtgatctcttgtaagatgctgcattgtcaaatggagaaaacattgtctttgagttgttaggagccttgagtgagatggtatgcaaatgtccagcccgtggcaggccctaagtacacagtagccattattaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagccctgttcttccattcattccgatgatttatattctctctgggcrtcttatattaaacaggggaattccgacatgttccataacacatttactgtaacttgataccatgaactacacttgctgttatttatcatttctttttattttctctcattgcagcataaagccaaggtagaarcaatgaccctggacctcgctctgctccgtagcgtgcagcattttgctgaagcattcaaggccaagaatgtgtgagtgttccagtggagggttatagatcataatttyttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattcaggaacaagtaaactcagttatccagtatggcagggaggttgacaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagagaaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtgcgaaggataagataattacacaagaggcaccagaaccactgaatgtggagagctctcataaatgacaagctgcctttgggttaggctctgttgggaacattagttctgcagtgttgcaagcagatgaaggatgtgagggaagggatcttaaaccagatattcaaatggccctgtggggagctgacaccacactgctgtctagtgtccaattctccttgcatggctgtgtcacccaggttggaacgtagtgcacaatctcgccttaatgcaacgtcccactgcgggcccaagtgattttcctgtcccagcctcctgagtagctgggactacagatgcctgccaccatggcctgctaatttttgtatttttagtagacatagggtttcaccatattggtcagactggtctcaaactcctggcctcaggtgatccacccgcctcagcctctgaaaatgctgggattacacacatgaaccactgcgcccagccgctctactttattagatttaaaaagtttgctctcagctgggtgcagtggcttatgcctgtaatcccagcagtttgggaggccaaggcggggagggtcatgaggtcaagagatcaagaccatcctggccaacattgtgaaaccccatctctactaaagatacaaaaaattagctgggtgtagtggtgcacacctctagtcctagctacttgggaggctgaggcaggaaaatcgcttgaacctgggaggcagaggttgcagtgagccaagatggcaccactgcactccagcctggcgacagattgagactccgtctcaaaaaaaaaaaaaaaaaaaaaaaagtttgtactcagcctggcgtggtggctcacgcctgtaatcccagcactttgtgaggccgaggtgggcggatcacctgaagtcaggagttcgagaccagcctgggcaacaaggtaaaaccccgtctctactaaaaatgcaaaattaactgggcggggaggcacatgcctgaaatcccaactacttgggaggctgaggcaggagaatggcttgaacccgggaggtggaggttgcagtgagctgagactgaaccagtgcactccagcccgggtgacaagagcaaaactctgtctcaaaaaaaaaaaaaaaaaattgactcaggctcttgctggagtatgtcagtgtcccaagtcattgaggtctacattagagtcagtcttagtgagagttgcaacatcgcctaagcgcagaccccaagctggcttgtaggaacagtgagataacatcccccagccagccagatctgagagagccctcctgtgtgtgtcctttgcagcgcttggctgttagtagcttccaccctttgccagaactatcaagaggcacctcaacaggctgcaacactagcattcaagacatttgttcgctgatttgcttcgtcattcatttatccaccggttccttcacttcacacacatttcaggagcacctctaaagccccagacattcttctgggctctgagaagagagtggtggccctggaagccacagtaaccgcacacaagctgtcacctcagttgtcagctattatggatggctgactcctcaaactcatctgtctgtggttgtttgggagggaatgataatgacaagaacagcagcggagtcagcagctcatttactgagggcttatgggccatacgtggaaaatattttgcatgtacgttttgattcaattctcaaagcagtccttgggagtagatgctattaatatctctactatacagataaggaaagtgaggctagagaggatatataatttatccaaggcatgtggaatgtgggtagaggggccgatttagcctcttcacggctccaacttgaccaccgtactatactgtgtttcattttagtttattttttatttattttttgagacagggtctcgctgtgttgcccaggctgaagtgcagtggtgcaatctctgttcattgcaacctctggccttgggttcaagcgattctcatgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcgtgagccaccctgcccgaccctttcattttaaatgtgatagaaacagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctyttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgcgatcaagccagagtattatcaggctctgagttcctgtgtgtattcccttggtccatgctccatctcaagtgtttctccacactgggataggcagcatattgtgtagtcttagagcagaaaaggtagaaacagattcttagtacaaacactggtgagaaaagcagcatattgtactgtggaaccacccgccgtctgccttctgtgggagatggggatcagcctcttcctggatctcttctttttattcgggtgctgggaggtgaggctgcaaaggaggctgttgtagagggagccctcctaaccatgattatgtaaacaatagctgctaggcaacttgttgtttgttttatgcaaggcagtgtgctaagcacttacatacatgtattctgtctgtagtttgttataagagtcctgcacacttaaccatgattatccctactttgcaaattacaaggttgcagtgcagagagcctaagacactttctcaacttgagcaagtaggagatccagaatttgaacccaaatctctctgaatccaaaacgactttttgttactttgcacacttcagtcataggaatttcagtgtggatttctgtattggttatgtattgccgagtaagaaatgactctggccaggcacggtggctcacacatgtaatcccagcacctggggaggccgcagtgggtggattgcttgaggccaggagtttgagaacagcctggccaacatggcaaaaccccgtctgtactaaaaatacaaaaattagccgggcatggtgatgcatacctgaagtcccagctactcaggaggctgaggcatgagaattgcttgagctctggggtgggcagaggttgcagtgagccgagatcatgcctgggggacagtgagactctgtctcaaacaaattactccaaaatttagtggctaaaaaacaacataaaacaagaaacatttctgttgtgcctcctcttttcctccctccctctttctcatagttaatttgtttgaatcaggattcaaataaggtcgatgcatttttaatctataggttttgtctcctttttttttttttccttaaaaaaatttcttttaatgcaacagatttaagggaccagggtgttctctagagcaggggtccatgacctctaggccacaaaccaatagcggagccgtggcctgttataaattgggtggcatggcagggagtgagtggtgggcaagcataggaagctgcgtctgtgcttagagccgctctctgtcactctcattagtgcctcaggtcctccccctgtcagatcagcaacagcattagtctcataggaccgtgatccctattgtgagccacacatgcaagggatctaggctgcatgctccttacgaaaatctaatgcctgatgatctgtcactgcctcccatcaccttcaagatgggatygtctagttstaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccacttgctggtgccaaaaaaatttggaaacctctgctctagagatttctgcagtctgtactttggtgattgcatctctgtggtgtcttttaacatactcttctgtctcctgagtttcctgtgaaagggtagataactcaagagactcaatcaacttcgtgtttaatgttttcgtaagaatacttcagaggcagtggtgtaatcgtccaagagtacacacaggcctgatygccaaagccagttttcttcaggcccagcacgtcctgacctcctcactcctctgcccactctctgtttactcactccsattttcattcattgattctgttattctccactaagttttctgggtggtcagcccaggaagcctcagcctgcttccagatagttctcctcagagttagcggtagcagcggtcgtcggccagtgtgtctcgggtcaaattattttgggcattactggaaagttccaaaccaaagcctgtggtaagttccacccaaactggcttgtgagggatatttttgtttaaactgcattcctggagaggagccagacttcctactgcctggcagcagtggtgtccataggagtatgaagagctgggaccctttctaatcactcagaccaaatattggggttttctgaaatggactgagaaataacagtatgtttttatgaggctttgcacattttccttcctagcagtagctgcttagtctactgaaaagtgcatattttgaacagggcctagaagagttaacagctcctagagagaggtgctctgtaatactttttcttcttcaaaaaatggtttatggctgggcgcaatggttcatgcctataatcccagcgcttttgggaggccaaggtgagaggattgcttaagcccagaaacgtgagaccagcctgggcaacgtagtgagacgctgtctctgtattacaaaattttttaaaaaacggtttgtaggtccttaagtccctgataaaatagagaactgaattgcaatcctggaacttaaaaagttggtgacgacacctgagatatttattacttagattgcagttactggtcagcttgtataatactgaccaagggttttgattcttcctggaattgataggaaattcatattaaaataattacccaagtccaaacatttttagaactgcatttttgatcatggatttttatgtctcttctgaactttctgtcaccggtataatttaaagaaattatacttaagctttgtctcacttagaagataatatagaacagtggtgtttttttaattaaaaaaaargttaaaatracggttttgtatccttgctttacttcttaaacatatgggaggaaaaaaaatctttaacaagtttatttattttcattttctgctaaattactttcagaacttgaatctactaatcccagatataatattcttggattcatattccaaattttgctgtctcaaatccatctagggaagtgggtgggctataaattataaataaattccaaattttgtgggatgaattaccctgaagaccaacgtgtaaattacatattaatctttctttttctccctagctcggttttaagaataatgttttagccaacatatctgcattactcttggctcaayatgagaaatccatttttggtttgcctaacagaagatcatgttgctttgcttctctacacagtatgaaaacccaaagaaaagaaaaacagaggcagttttttgctctaatgaatgctctaaatctagctcttaattatgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatttctgaaatagatcatacactctcttcccaaaaacatcaaagtatgaccgtaaagggcagaggtaggtaaacttcttgtaaggggccagagagtgaatatttgagaattttcagactattaagatctctgttgcaactgcttgcttttgccgtggtagcctgaaagcagccgtagatagtatggaaatggatgatcatggcagtgttgcaataaaactttacaaaacagacaatgggccagattggccaggggccatagtatgctacccctgggcaacaacctgtatgccctggagtagtgtaaagaacgtgggtgttgggggtcaactgacgcttccagctctaccacttactggctgtgtggctttgggcaaactactgaaaatctctcagcgtcactttccaagtgtgtgtaatgtgtattttcacagtgctttgcaggttgttgattattgaaaatagccataatgcatgaaattaccagacacatctcactttatggagcctggggctattggtaatatgcatttctttctcatcttgatcgtaaaatgatcttagaaaggtttctgagaatwtatagagtttaagacagcaataagacaactaattaattaaacaggaaaaggggatgttgtgctcagagaggaagtgtgggtctcataagggctttcacaatcgtttgagaggacacgtgtgatgtctcatgcctgttatcccagcactttgggaggccaaggcaggcaggttgcttgagttccggagtttgagaccagcctcggtaatttggcaaaaccttgtctctacaaaaattacagaaattagttgggtgtggtggtgcacacctgtagtcccagctgcttgggaggctgacgagtaaggatcacttgagccagcatggtggaggctgccatgatcatgctactgcactccagcctgggcarcagagccagaacctgtcttgtaaagaaaaggaaaaagagagagaagggcagaaagaaagaagggaaggaagaaaggaaaattgggcccaggaatgatctttacaatgcctgacaaccaagagaagaagggaaatgagcttcacattgcctgcaagctctarggtgacaagagccaagagaaattattgttactgtagtgatgttccactgaggatcataaagtactttattactctactgagtatggttattggatatgtgttcttctttttctttttctttatcttttttgctattcttttgttattcttgatttatgctgatggaaagccatggacccaaggatgcttcacagttttctttcggagtaaatgcttagattccattttctttgacatgactatgtctgttcctcttgattttaggcatctttttcagatgagttgccataaaagcagcctgctctggataagtgaggtacagcaggacacactgcaaatactaggaatccttaagtacagtggaaccccagagcactctacctgctttctttctcacctccttaaaaactttttttgcccwcacctcatcatttattcagcagtcacaacagtgccaagaacttggctagagattggaaataaagcttatgccttctctcatatctcctgtaccttatttctttcttacagtagttgtgatgcttagcagttttttgataactttttataatgccaaccttcaaaaacctgcccctggtggagagaataattattacatcaattaggggtcacttagcatgacatttgtcggaaaaaaaaaagttagtgagcctttttgccatattaaaagtcatcactgccaagacataaatgaaaatgtgttcgaattaaccacaccaatgttcacaaaataaacatttttgatttcccaacagaatcctaggtttaactatcactatcatctttcatgaaatcaaagtcatatatgtaaattgaacacaactttcccttccatagagagtaaaaaccacgctttggagggtagatacaattaccccagggttgtcttttcccactcctcacaatcccaccagtgcacatgcaaggtgatgtccttcctttagctatagcaaataatgttaattattgttggtgttaaataatgattatgtaaagcactagactagacattcgtcggcaaagtttttctgcaaagaatcagatagtaaatatttttgctcttatcagccagacagtctctgcggcaaccattcaagcattgttgaatacattgttgagtgttacatgagactattgtaatataaaagtagcctgggacaacacataaataactgggtgtggctgtgtcctaataaaactttatttacaaagaacaggaagtggcttggatttggtatctggcctggcagctgtggtttactactccttrgacggtggcccagagaccctttaaatgaaattcaktttactagcaccctttttcatcatgagaaatatattctgtttttcttaraaaatgggttatgttaggtctggtcaaggtaaataagtgttgagagtcgatgttgtgtgcatagttaatttcaattctttgaagaarctcccccatgatatttcacggctgagagaagaggaaagagtttaagtggaacagtgtgctttgctgagctttggaaatattaccatatagggaagcaggtcaataagacaactaagtgctgtttcaataacgaagatactgaagcgctaattggagtatggaaccatataatgatgataataattgctaatatttatcagctatttatcatgtgtcatgtacagctaagcacttacataccatcccattttatccttataatgackctaagagtgggttaaaaaatggcagaagaatggcagtgtttaatggttcagcctggtgcaatgattaaccacattttacagactaagaaattaagaacctcaaccaagttcatgctagctggtacgcagtaaggctagaacttcgtccaaaatctcttcttctgttgagctcagcttgcatagtagcttggagaatcagaaagatctgtctcatttgggaaatataccatgtaaaaaacattgtttctaaaggagatttgtcccatgagtaaaatagatgatggacagccactgcctagtgggacaattagaaaggtcagttcaaggttggaggagatgcttctttcagccaattttcctttttctcaggatcacctcaggtgatccgcccacctcaacctcccaaactgctgggattataggcgtgagccaccgctcctggcctttcagccaattttctatcaccaaagggaaatcgttttgctggaatatgtgtaaaggaggttaaagtcagaagagattctcgtccgctcagttaaggtactcagactattttccaaccaatcaagagggtgctgcttcatggagttcgtttaagctgaagcggcagctgktgactgtcatttgcatcatctttatacatttactgtgaatgtcactgtccatttccactttctttctacttgtcttcaaattgatgcttatcaagtagacagaagaagaccaaggggtcgttttgctatttatacctccaaattgatggcgtgatcactctcaagtgcaaacccagccctgacactgtcctgtttggcaatgtcctgctatctgacctgcaaatagctacacttcctgctgtggcccacccaggcctctgggatctgatcccttctcccatgtcacctgtggccatgtcttccccaacccaggcttctctgctccgctgcttatgttctggatcctgactctgagcctttgcttgtgtggctcctctcccacttgtccatcatcatgtcagttatgtaagcatagattccaaagtgacaatgagggtagttaggatggcaagaggagaaaaaccaagctggattcatggattgcttgtgtcacgtcctctacagagcctcccttctacctgctcttacccgggcaccacagttgatgagttattttttggaccatcagcaacacacccaatcattgtacatggaatacttyggggatgcttttttctatattgattttacttcattaaactgagctccagaggagcagaaactttggctaatacatcttggtcttagcttgtaatatctgtgctacaacttattaagatggtgacgctggcaaattccttaatctttctaattcttaatttcatcagcaaagatgggaaaggatactaacaccactctgggttgttgagaggattcaataactgaatatttataaagcgtagtacctgatacttaataaaaaagtgaattttaacctgtgtcatcattgtcatcgtctttatcatcctttgcaattattacatttactgccttctagtacaaggaaggggatgggtggctggctggctaggtggatagaaggatggaagaggtaagtacaaggaaggggatgagtggctggctggctagatggatagaaagatggaacaggtaagtataaggaaggggataggtggctggctggctagatggatggaaggggtggaaggggatgcaagaggtaagtacaaggaaggggatgggtggctggctggctagatggatagaaggttggaagacaggaaggatggaacggaagaagagggaagaacaaaaatggaaacacatagtactgttaggtgaactgaacttctaaggtgccgattctcagtgatagaatcttgagttgatacctccttgggtggcatggagcctatacctttgtagatcttgggaaacaacttctaaagtaatcatagttgtatgtaatcgtagttacaacaatagttattttaggcacataacccaaaggttttcttacaaggaatctatgaaccttaagagtgagggcttctgttaagagtaagggcttccctggagtggacatggatcatgggactgagccagcttggcattgttgggttgaacagggagcgacacctctcagcccagtctatcaagcctgctctttgacctgcagtgagaccacccacgcagacatcaatgcagcaaatccccggcgtcagggtttcaacatttggttactctcagagaactctcgatttatataagacttggaaaaagggtttgagtttctgtggtttacaattatatttcccaacttggcccatgaatccagcttggtttttctcctcttagcatcctaaccaccctcattgtcactttggaatctacacttacataattgacatgttgagaagctgtgctaaaaccacactgaaatcacattttaataacatgggaaccatcttttcccagtaaattgttgagaagctaattcttgtcagcctaaaaacttgaatatacatttgaataaatcagcggtgctacaccgtggcagcctgctgaaaatccccaaggaagattatatttttagttgagctacttgtcactgcactgtgtttttaatattgtgagtcctttcttgtcttcatttttgaagaatctattgcataccttgtcattcagaaaaacataaacgggacctctcaattagcggtaaagttcgtcagtttaacttttaagcttaaactcctgttatagttcggtcacttactcgtcatcaaaaagatatttgagctgatattatgcaataatttataaccaaaaacaggaggaaaaggtctctgtttgtctcagaagtacaagttatgcataaggtgacaaattacacagctttgggaaatgggtcttaatggaatgcaccaggctaatagaaaagcagtgcctcgatttcccacctcagatctgaaaactcctgagagactgacagggcggttccccagcttggctgtgtgaggaatcagctgggaatcgaacactgcagtctggctgtcacccccaggattctaatgtaattgttctgcattgtggatcgatggatggatggatgaatggctggacagaaggaagacttggaaaaaatctttgagtttctgtggtttacaattttatttcccaacttggcccatgaatccagcttggtttttctcctcttaccatcctaaggagggagggagggaggaaaagggggaaggaagcaggtagaaagggaacagggaagggaggactggaggaaggaaagcagggatcattctggagtgtacactgggcatttgattttaaagcaaatccaagagatcattaaatttgtatcaatgaatacactgttacccctcaatcaacactacaattcatatatcagaatagcactttgttacttgtttctgagatagggctggctctgtcacccagactggtgtgcagtggcacgatcacagctcactatggcctcagccaccagggttcaagtgatccttccactcagcctcctgagtagttgggactacatgcctgcaccatcatgcctggctaatttttatttttgtagagacgaggtctccttgtgttgtccaggctggtctcaaacttctggaatcaagtgatcctcctgcccctgcctcccaaaatactgggattacaggcatgagccatgtccagctgccttgtttttttctttgaagagaatgatagaccttccataggaaaaatgttaaatatgtgtgtgcagaaataaagatttcaaatatttttgcaagatattttttctaataccacttttttctacattttccataatttagtgaagatagtaaattaacaaagtggaaaagactgaatattttaagaaaagccaagtttaaaaattttgaacctaatatttcttaaagtagctaaaattcagatattgagaataaattcaacttgacatggcaaaattctaataggctgaaataatgttttggtctagaactatgtagctttgtgtagcccatcaattgtctaaaaaaagagtaacctattttgatgaaactcgctgtatcttgtaacctgtatcctgtcttggtattgtgggagtatatatgatttaggggaaagagtctggagagaccttaagtctgctttagggaaagggtgaggaaccccactgaaggctacttaacgcattttgagaatgtcagtaaagatttctcagagcccagggattttttttttaattgagacataatttacatacaatacaattccttttttcttttttttgagacggagtcttgctctgtcgcccaggctggagtgtgatggtgtgatcttggctcactgcaacctctgcctcctgggttcaagtgattctcctgcctcagcctactgagtagctgggattacaggtgtgcgccaccacgcttggctaatttttgtatttttagtagacacggggtttcaccatgttggttaagctggtctcaaactcctgacctctagatccgcctgcctctgtaatcccaaagtgctgggattacaggcgtgagcccctatgcccagccaaaattcattattttaagctgtacaattgagtgatttttattacgttcacaaagttacgttaccattaccacttttgaattgcagaacaatttcatcactccaaaaagaaatctcataacaattagcagttattttccatcgctacttcctccagtcccaaggcaatcagcagtctgctttctatctcyacctgtttgcctattctggacatttcatatgagtggagttagataatacatggccttttgtgactggctttcacttagcataatgttctagaggttcatttatgttattgcaaaaatcagtacttcatttctttttatggctgaaaaaaattccattatgtagatgtgccatatttgtttatctggttgtcagtcggatatttctgttgttcctactttttggctactgtaaaagatgctgctatgaacattattgtgattattataccttatttgtaaacatcatgggtggggggttgcagtaaacatgttggaaagtagggttggaggtccgtagaaattgggggcttcagcacttcccccaagctcaacaccaaccccctttctgagcccctcttgaaggagagttccctgggacgtgcctggtattggtacaatcagtcaggaagcatttttcctggggagaaacttacaagtccacgatcaaagccaacaagagacaaggtgttacatgactcattttyggtttaagaagtgacaggctgattctaagttgggttcaattattttgttaaagcgttttgcttatttgacttctcctgacctcggaaataattctaaccaatcagtgctggctcccattggccctggggtctggttgctttacagctggtgacagggggaccactccactaccacatgtgaattaatcctcaactccagagccaagtgccattctccagcaaggttgtatttcttcattagctattcccagggcccagaaagtcccagaggatgtcagagtacattaatttttatcataacatggaatctttcaggtctgaatggcagcacacggctgtcaggggcttctgaactctattacagctccatatatctctaggcaaaacagaggaaagagtcgtcattggcaagggagatgtacaaaatgcatgagatgttttattttttgagtgacttgaccacgtgcttaagcacattccccaaacaatttttttcttattgtttgtaagttgtaagttgtaaattcacctctgccaccacctattaaagcccactccctgcattaaaactgtataaagtgtatttaaataaactctctttgcatgatgtgaatgaaatcgtcatctggtacttaaaactattctataaagttattaaaaaattaatgttcccttcccatgatttttctgcagaatttatgcatccatgatactgcagaagttcataaataatggcttgtattgctgctttagtattgctttatgcctacgaaatataatgttaatttgtagcaatgctaatgtgttttcaggaaggctctttgtttattgcctttattttccccacttaccaagtgggtaaaatgctttgagggttgcattttatgtattcaggaggcccaggtattattttaatagaagcactattgacaaataccagtcatcccccctgtgccaggccctggatgaggcactgcttcgcatgggggctccccagattgtcccacaaggaaagcatagtcaaagacaaagttttcagttgtaagagtaaatgtgttctgcctaggcattgtcaagtaatttactgccagctctagcccttcactcaagtttcctggatacttttgacttcttagccatggatgtgtttgaaggctgcatggaccttcacttacttgcactgcaggtcagcctaattgcatgagctctgtggaccacagagcagggttttccaaagttcaccaagacaaatattgtattatcttaacatatattcattttttaaaactgaaaatcagaagagcaactccacctagcagaagtcttttgcaaagggcgaggcgaggctaaaaagtatagaagagttcgtttccagtgcaattttataaacacagatggtccttaaattaagcaaatggtacctaaatgactgtgttgtggataatggtaacagagggagggactcgggggttttttaaaaagtactgattgtatgcagtgttttaaacagataactgtgatcttagtgtgatgaaagatgctgggagatttcaccagtggtatcttattatttttcggggattttgtaattcaacaaaattctgttgtatgccaagcataaccctaggtgtgagagcacaaggtgacttcagataccacctctatccttcaggggtttggggcccattattatgacttaatccattttgggcgtgagaagctgagggtcacagaaagaaccaattccctctttaaataatgccaccccaaccctcctcatctgccaggtctttcccttcttctatttgtatgaataatagtcactttctcttgtggagttcgctaaattctactttggcctatcaaatttctttcatatcacaactaaatttcttaaggacgggactatggttcatttgtcagacgaacaaatgggaatttgccaagagacacttgggttaatttacgtcttttccatccaagggcactatgttgaagtgaggctagtaggtcatgagtgtggttgaagttactttttcttactttcccgaccagcccccatccttactgcacttaaagttgattgtccattttattaaatgtccccaggaagccagaacacagggcagtaaagtgctgaatgcaaagggcaggagaaaaatggaaacaaccagaactgtaacaccaaggaatgagacctgcatgtcagatatcatgcccattgcactaagtgccattggggcacaattatcaaatggatgcattttccctagaaaaccatcttggagagcatgtggatgtacttctattttacatttccccctatttacaatcaatgagattgagattttgttgctgggactgctgatgatgggatgggaaaatataatcaaggtaatggacatgaggcaaaaatttaaggaaatgacaaaaacaagagtatttccattttcagttaagtgtatgtactgatgttctggaattcactataagaagttgcaaatggtgcatgaaatgaaaaattcctggtggtctccaggggacacagccggtgctgtgctccactctgggtaactgttttggattattttctctattccaactgaaataaaaaaaaattaattaaatgtggctaggttatcttgacagcagaatccattcccagttaattattattttaatacttgatggtgtctgtcaaattgtcgacatgtgacggtcctttcaaatttaaaggaatagctgatggtcactggccacccaagctgatactgattttatatgttgatgtttctcattttatttgctctttccttgaatatttattcaggacattctctaccagacatattgagtaagggcaacagaaacaatacataagtatcttataaatgtggaaaacaatgtatatgtgttttttatctctcaatgattggtgggtaccatatccccaaagtagaatgagcatttgagaaaacaggaaatatcctcttttaggcaccatctctgtcaaggctgatgctgggctttttatatattttctctaattcttgtggctgtcaaacaaggtgggcattatcattccctttataggggacacagctgtggctcagaggggtttattcactttcctgagggccacacacataatgagaggcagacacaggtgacgaagtgagttttccctgtcacgccatcttatctgtcacatacctctctgacatgctaaaattgcactaaacaaaagaattctcttatgcacatatcatgcaaaagatattctttaactggggatcatgtttctcattccatcaatagaatgactaacattttctgagggtgtctcacgtgaaagtaaatcgctcatgtttgttctttttaaaagatgcccttcgtattgtgtatcttgcagtcttgctttctcaaacttaagccaactatatcgtcatttttgcaaaatcactgcgtcagtttactattatttaatgtttattgctaccaattttaagaaatcctttataggactatttgtgaaattgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttagcctcctgagtagctgggactacaggcatgtgctaccacacccagctaattttttgtattttagtagagatggtttcaccatgttggcgaggatggtctcagtctcctgacctcgtgatccgcctgccttggccttccaaagtgctgggatatacattttttttttttttttgagagatggagtgtcactctgttgccgaggctggagtgtagtggcgcartctcggctcactgcaacctcctcctccggggttcaagcgattctcctgcctcagcctccccagtagctgggattacagtcgtgtgccaccacgcctggttagtttttgtatttttagtagagatgggtttcactgtgttggctaaggtggtctcaaactcatgacctcaagtgatccgcccgcttcagcctcccaaagtgctgggattacaggcgtcagccactgtgcccggccggatagaaataatttttataaactccttggatgctacctaaaatcatcttgttttgctagtggcacatgctgcattttgggcagctgtggccttggtggattgctgaagtagatttgaccttacctggactgaggcagctgttgaagggaattgctgtgttcagtgtatactgccatccatgatttcatgaaaccagctctagctatttaagcaggggtcaaacttagaattctacattatttttttcccttttctgggaggaaagacagttgaacaccagcaaagactaagaagtttcttagaagactgtgggtccttgggccctttctattgaatttcagagtatttccaaatactatgaagtcttgcagcttagttgagaaatgccccagatggtgtgacattctgcttccaggagggattggaaagtatttccttttacataacattccactcagctcattcctttgctgtgtctgaaattgaatcccccaaagccacaattatcttaacattcagaagagtgtttatttaatctgcaaaatcttgcctcacttttggggagcatgttaacaatttcacttacaaatcttctgtgtaactcaaccccatggtggtgtctactgctgctcctagactctttaaagcacctttctcatctcaggtttgaaatgatatgtctcattcttgggttccttgagtcgtaatgggtttgtcttgtctccacagcataaatgactctttcttgatcaactagaaccacatcaacttcttccctccagcttcagtgatatattgtgaaacatggctattcaacgtcctgtagaccaaatgccataagaaaaatagcattgattcaaacgtatccatccagatacctaaaaaagttttacttcttaccacatcttgagtctgggcaaacacgcacttcctatggacattgattactgtctactgtagagataacatttgcacatacagattatggcacatggtagaaagtgttaagtaatgtaggaatggacatatcccaagcaaaattggaagccaagtcccctgtccctgctcaagttggtatgactggtgtatggtgccttaatgggtacttaaagtccaggtgagagtggcaggaggcagccaaatgcctaggtagataggagccggtccctgttgaaaccccacttccaagttgaagacagtttaaagactgaaagccaagctacaagttaaatcctcggaccagattgagaacttgtcttcttacttggtgcactcttctgattgatccccacctttcacctattttacatattcctgcccttccctaactggtttcctatgctgtcatgcccacctttgagtgttgccttcactttaaccttctgtgcatgctcacaaagtaattagcatgtaycctccattctgagttaatataaggccccagacccagccacatggggcaactttactgccttcaggtaggggaaccacccccaccacattccctctccactgagagttttccttttagttaataaattcggctccactcactctccattgtctgcatgcctaattcttcctggttgtgagacaagcagttggacctagctgagctaaggagcagaaagactgtatcacagggaacttgtgtaacagcttgatctcctgtcctacgtagctatctattggtaagaagttgaaggaacttgtgtcattccgttgtgcctgtcgtcttgaccttgtaaaaggtcttgggtaagcatgcaagaagttttgaagagggagatacagctaatttgcagatraaragcaagggaagaattcctggagaaaggaagagtttcctgagtcacctttgggaggtaggaagggtttgacatgtaggctgggcatctgggaacgagtgagggattctgtgagccccatctyagtggaccactcaaggaaggtgggtaagccctgggtataagtgtgtaagcagggaacagaaagtactgtgatttaaaatatgttaatttttctactgtacagatgagagccagcttggagatgggctgtagctcaagyatcttacctacctctgatttcttaatgccacgttataaggctgctgcttatagctcttgaagtcactccaaaaacagatgagtgagaccctgttgctaaagtcccactgggtgtagattattcacagatgtatacacagtggctcactccaggtaggatgtgatcagtgcttttagaaatacagaaagtcctattggtttaaaaaaaatttttttttgtaatgaattgagttttaaagctagcactgtacaataaaagggtgaatttcactatgaattatgacaaacacagtcatagagctgccatcatcactgtcaagatacagaacagtgccatcaccccccaaatgtcctctgtgccttactgtagtcatacctgctcctgacacctagcccctgggaaccattgatcttttttctgtccctagttgtttgtcttctctgcaatgttacataaacagaaatattctgggtgtcgcttttggagtttggattccttcccatagcataatgcatgcagtatttgtctgtttctgctaaattacccccaagacctagcgacttaaaacagcaaacatacactatctcactctgttagttttccattgctgttgtaataaattaccacaaacttatgtgcttaaaacccaaagctattatctgacagctctgtaggttaaagatttgtcatggttctcattgggctaaaattaaggtgtcggtatggctctgctgctttctagagactccagggagaatatttttccttgccttttccagcttctaaaggtcacccacaacatcttcaaaaccagcactgttgcatctctgaccttagccctgtagtcccatttccctctagccacaatcgggaaaggatctcaggactgttgtgatgacactgtgcttacctagattatctagcatgagctccctgtctcaaggtgatagagtttgcatgtttttctcctgcacatgccatgttgaaacataatccctagtgttggcggtgggtgtgctgggaggtatttggatcatgggggtggaaccctcatgcatgacttacggccatccctttggtgataagtgagttcacatgatatctggcaccttccttcctctgttgctcttgccctcaccatgttagctgcctactccccttttgccttccgccatgactgtaagcctcctgaggcctcaccggaagccaagcacatgcttcttgtagagtctgcagaatcggagccaattaaatctcttttcattataaattatccagcctcagttacttctttattgcagtgcaagaatagcttaacacacaaggtcttacccttgatcacggtctgcagcatgtcttttaccatgtaaggtaatatgttcagtggctgtgggggttaggatgtggacttctttgggggacttttatttttcccagttactatttttgtgactcaggaatttagggacagtttggctggttgtttctggctcagggtctttcttgggctgcaatcaagatgtcagctgggggctgggcatggtggctcactcctgttatcacagcactttgggaggtcgaggtgagtggaccatttgaggttaggagtttgagaccaacctggccaacatggtgaaacgccatactaaaagtacaaaaattagttgggcatggtggcacatgcatgtaatcccagttagttggggggctaaggctggagaacagcttcaaaacaggaggcggaggttgtggtcaactgagatcacaccactgcactccagcctgggtgaaagagcaaggccccacctcaaaaaaaaaaaaaaaaaaaaaaagttagctggggccaaggtcatctcaagtcttgactatgaaaggacctaacatcatgcatggctgttggcagaggtcacttcctcatgagcattaaactgaaagctataattcctgactattgaccagaggcgaacctcagttccctgccatgtgggcctcttcatggggcagttgataacacagcagttagcttccattggattgagtaagcaagagagcaagaacaggagtgatacagaagccagcatctttttgtaaaccaatctcagaagaattgtccatgattttttctatattctgttagttagaaacaaattcctaggtctcacccacccttgaggtgaggggattacacaaaagtatgaaaaccaggaagcagggagcattgggagtcatttggaccctgcctaggacagtgcgtttgagatccatgttattctatccattagtagtagtttgcttctttttaatgttgagtaatatgccattgtgtgtttatatattgctaatggattttaaagagggctaatcaacgtgttgattagagggaaattttcttcagtgaaataatatttgagcaaaaccttgaagaacaattaggaatttgacagagggaatggcacgaataaagacccagacttaatcaagtgaggggcgtactcatccatggggcagtggatgattcacctgcctggagcttaaggagaagggggtgtagttgtggctgttgctcagaaggacctgaatgtcaggatgcatttgtgtttaatttagcagacatttaggaaccattaaaagtttttgagaatgggtaggtaagattagaatagtattttaataagtttaactaggctttaaccagtattcataaaaagtcaagtgggagaatgtagaggtgacaagaccaggtgtgggctattgcagtgactacacctaaaaggaacagagctagaaacatggagtgacatgaagtcattgtcttaggttggtgatcctagcagctgagcctgggatggggattcttgttcctatgatcgattaggggactgttcccagaggagagcggagagggaagcaggctttggtttctactggaaatctgtttccgcccgattccatggggagctctggagaaggaattgtatcaccgagttggtcctccttgtcaacagagcatgtgtgtgggggtgatgacttcccagatgtgagggtgccctccagcaatggacagttatctggaggagttcatgctccagaggtagtgcctacctctgtggagaagtaggggatggcacggtattttaggggttcctaatgagcctagagatactgacattgaccagtcatggagactaaaggagaagatgggatagcacattgttttcctaagtatttgtaatcaggtgactggtttgcaaatatcagccattacagaaataaagggtatcaggacggggaggagatgtgaggagagaagatgaagagtttagatttaggcatgttgaccctgaatttgtgggaaggtatccaggaagataagactgacaggtgggaatgagattctggaacttggaaagaatatagtggctagagctaagggtttgaagtcttcatggcgattttgttcggagtcatggatttggaagaaactgctgcagggaagattttagagatggaatgaaaagagattggtgatggaacaatgggcaaaagaggaagggttggaggagacaaaaaatggagtggtagtggcattgggaggtccaagagtggatggtatcacagaagccaagacaggaaagtgagccacaagtgagggaggagcaggatcctctgcaacagggcagtctagtcttagcagagaggaggttgctgaatttattgattgagaagccactcctcgccaggcagttttgagaggttctggatggtgatagaatggaattcattcagctgatgatgagaagtagatttgggtcagggaaggagactgaatggagatgaatatttcaaaactatagaccataaatgggaagagagagacgagtgcaacctgcctaggtcaagtgaatgtccttttttctcttcccagcccttgtcttttttaccctctttgttttctgcatttctttccttctgttctgatttttccttacctgatggtcagaaagatctgattgagctgacgcgtagcaagaatgagccagtggagaggaaaatgtaaccacctaatgggttctcctttcctgctagctggacagagctgatttatcaagacgggggtactgcaaatagagaaagaatttaatccacacagagccagctgtatgggaaaccagagttgtactactcaaatcaatctccccgagaattcagggatcggagtctttaaggagaaatgtggtggatagggagccagtgagtgatctgggagtgctgattgtctcacgtgtccatgtgaagagaccaccaaacagggtttgtgtgaacaacaaggctgtttatttcacctgggtgcaggtgggctgagtctgaaaaaggagtcagcaaagggtgatgggattgtcattagttcttagaggttttggcataggcggtagagttaggagcaatgtttttggggcagcgggtggatctcacaaagtacattctcaagggtggggagaattacaaagaaccttcttaaaggtggtggagattacaaagtacgttgatcagttaggtagggacagaagcaaatcacaatgggggaatgtcatcagttaaggctattttcacttcttttgtggatcttcagttgcttcaggccatctggatgcatacgagcaggtcactggggatatgatggcttagcctgggctcagaggcctgacactgatttgttggcttgaagatgaaatcacagggaatcaaaggtgccctcctgtgctgactcagttcctgggtgggggccaaaggactggttggcaggtctgcatggggccaccgtgttgtcagaaatgcaaaaatctggctggtgcaatggcttacccctgtaatcccagtactttgggaggctgaggttgtcaggcctctgagcccaagctgagccgtcataacccctgtgacctgcacatatacatccagatggcctgaagcaactgaagaactacaaaagaagtgaaatagccagttcttgccttaactgatgacattccatcagtgtgatttgttcctgccccaccctaactgatcagttgaccttgtgacattcctcttcctgaggcagtgagtctcaggagctcccccaccgagcaccttgtgacccccgcccctgcctgcaagacaaaaccccctttaactgtaattttccactacccacccaaatcctgtaaaactgccctacacctatttccctttgctgacccctttttcaaactccgtctgcctgcactcaggtgattaaaaagctttattgctcacacaaagcctgtttggtggtctcttcacatggacacgtgtaacagaggtgggcagatcacttgaggtcaggagttcaagaccagcctggccaacgtggtgaaaccctgcatctactaaaaatacaaaaattagctgggcatggtgctgtgcacctgtaatcccagctactcaggaggttgaggcacgaggatcacttaaacccaggaggaggagattgcagtgagccaattgcgccactgcactccagcctgcaatgcagagtgaaactgtcttaaaacaaacaaacaaacaaaaagcaaaaatctgaaaagacatctcaaaagccaatcttaggttctacaacagtgatgttatctgcatgaataattgagaaagttgcaaatcttgtgacctgaggaataacggctggtaattatttaaaactcaagcccctctcatcctaacgtggtggcctttcattcattttacaggaacagtttagttttgggggaaagctgttatttaaactataaacgaaatttctcccaaagttagcttggcccatgcccaggaatgaccaaagacagctaaccagttaccggaaacgggtcccaatctagaccccaagagagagttgttggatcttgggcaagaaagaatttggggtgagtctataaaattaaagtaactttataaagaaagtaaaagaataaaagaatggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaggggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagamcttttacaattcaataatgaaaactcatttaaaaaatgagcataaratctaaatagatattcctccaaatatgatacacaaattgccaatgaatacataaaagatgttcaatctcattagggaaatgcaaatgaaagccacaatgagattccacttattgctaggatggctaaaataaaaaagtcagataacaaatacttacaaacacatggagagatgaaagttcaaatacagtcctggcggaaatgtaaaattgtatggccaaactggaaaacagtttggccattattcaaaaagttaaacattgaattaccatatgacccaataatcccactcctagatgtatcttgaagagaaatgaaaacatgcrtttccatagcatcttacaaatgaatgtacatagtagtgatattcctaatagccaataaatggaaacaatccaaatatccatcattggtgaatggataaacaaagcgtggtatattcatataatggaatattatttgcccattaaaaagaaatggattactgatatatgctacaacatggatgaaccctgcaaacatcatgccaagggacagaagccagtcacaaaagactacgtattgtatggttccatttagtatataaaatgtccggaataggcgaatctataggacagaaagtacactgatggtgttttgggaataagagtgtaggtrgatagagggtggctagtgattgctaagttttttttttttttttgagttaaaaaagtgctataawattagaatgtagttatggttgtacaattatttgagtatactaaaacagctgtacagtatacataggtagattttatggtatgtgcattatatttcagtaaagttctttaataaattagytaatgcttattgtagaaaagttggaaaataccaaaaaccataaacaggaaataggaaaaaaagtaatcctgactgtatatctggaaatcttttcgtggggtatggggtatgaatcacacatattaattttaatttcctgctttttcaattaaattgagaaagtttgggaacctctggcttaatcattatttatccacttctctgttgttggatgttagattgcttctagttcatatgtaattttataattttagttgacatgtcattatggattcttgggcataaacgtttatatgaattttgaatattaggaaataatcttggaagctatattagttttctaaagctattataacaaattaccacagatggagtgcctcaaaacaacagaattttactctcttacagtttcagagaccaaacatctgaaatcaagtggtttgcagcgttggctccttctggaggctggaaggagcatctgttccatgcctttctcctagcttcccatgactgccagccacccttggaatttcttggcttttatcttagtcagtctaatctctgcctctgtctttccatctccttctctgtgggtgttccttctccccttctgttttgtaaggataggcctgtcattggatttaaggcccaccttaatccaagatgatctcattttaagatgtgggacttaatcacatttgcgaagaccctttttccaaataaggtcgcattcacagatccctaccattcaactcactatggaagcaatgggatgggaggtaccattcaactcacagattcctaccattcaacccactataaagcagtggcatatgaaaaggatgggaggttgctatgggaatggtctgccccagatgcaggtaaaatggggaagcattttatatagaatggaaaaacaacagtaaagctggctaaaacttgatctgctttttacagtcatgtgctgacaattctaaacattatcaatgataaaatacttctccctcatgatattaactgtgcaatttttgctgcccctgctacatacatgctttattgcttggaaacaggattacttggtgaaataatgtgaatctttcaattctcatgatacatgttttcaacttaatatccagggtgcaggaatatatattcccaccaactttatacaagataatacaaatataatagtatgaataaatatgctaatttgatagaaaatattttaatatttactactagtgtagttggacgtgttaaatattgcaatggttatttgtaatctacctttataaaatttctaatgtctgccactgtttctgttagactcttaagaagatacgtgtttgtctcatagatttgtaagaactctttatatactaaaaatatggggcttctatatgattgcatatattcgtcacttttgttccactgttttagagagcagaagattttaatttctataaagatttttatgtttccctttattgcatgccaatgtttgttttttaaaaacttgtacgtcttaggctgcgatgtgaaaagtgtcttttttttgatttggaaacagagtcttgctctgatgcctgtagtggtatgatcatagctcattgcagcccttggaactcctgggctcaagtaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaattaatcaggtggttgaacctgagttccaactagggtgacaactcttcgcagattgcctgctgctgtcctggttttcacactgaaagttccgtatcctaataagcctctcatcctcagcaacggaggacagttgcccactcaaagccttgtgacattctagrgtatcctatttctacatggtgggaatctagaaracggagaaagaatttctcattcccgaaggagcatggattatccttggttgtagtgtttatgtccacatcacgtggattcccraaggagcatggattatccttggttgtagtgtttatgtccacatcacatggratattttatttttcaggcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtgggtttgaattgcatatttgttcacttatcccctttctcataccagctaatattcccccaaggctstcattctgaaaataattttcattagtcctgcttgagacatgtgggtggactcagcttggctcacttaatttttccaggtcttttttgttcgcctgtgattgtgggggactgtttagaaggactttctagagcaaggaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattagagcctgcgagatgaaatcaaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaaggacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagcaaagtagctagaaaaaaaaataacgtgcaaggggcctattttttcctccttcttctccgtcttaagtcctgaaatgttttagtgacccagaatgaagcttatttttttaatcatacttccataaaatgtaacccctgggacttggaagagagagaccagccaagggttagcttgaaccctttatcactcccaaacacaggggcttatggtataagtgacacactgcagatagatttacttttgccattttaaatttatgatggctgaaatgaaaggtaaatgccagtaataatcctcccccgtgttaaaagacatgaaacatctagtaattaggtggtaacaaaatctggacagccttatctttgcaaatcacaccaggtttgtgaaggaaagtggagtggccctgttaaggggcgagggaggctactgtgggggcaggcagcagagagagctccagaaataaatctgccagccccagtcatccaccagatgtggagggcaccacgggatatgtttaaatgagctggtatttaatgggagattatgtcgaattgtcagctgctcactctccttgtaaatctgtatctcaaatggtatttcgtgtgacgtctttgttctttgcttaactacggtgtaattcatgcctacttcagagatccaaatctcagcatcatttaaaagattagtttgaaaggaagggacttgggctcttgaattagacctatgttagtttatagggaggccttcctgaaatgtgttgtcaggcttgctcctgtgtgatggctggcactggttttatgctttccaattattctttgcacatcgttatttattattactgttattattatttgacatggagtcttgatctgttaccaggctgcagtgcagtggcatgatctcggctcaccacaacttcagactcccagggttaagcgattctcctgcctcagccttccaagtagctgggaccacaggcgcttgccaccacacctggctaatttttgtatttttagtagagacggggtttcaccatgttggccaggatggtctcgatctcttgaccttgtgatccgcctgccttggcttctcacagtgctgtgattacaggcgtgagccaccacgcccggcctctttgcacattatttaagggtgttttaacaaaatggcaatttccccaggctggcttgtgtattaccttcgcattgcatcccttggctcccatgagtgagcgtggtgacttggtgcgtaggtggtacgtgaagacagttgctcactacccaagaactcagggccctaaaccatgctgtaaaatgcaagtgctgatatctaattacctccatcaaccttggcagaatctcttcgttggagttaagaccccctgttaggggaaaaaagaaagtcctatgtttgcagaaaatattatactagactgctccaaggcaaaatatttattagccttcctgtgtcttcactgtgttttagttacttatctggaatctgagcaactgaattgagtttctgcatacctaaaatacatcatagtgaaatgagaagttgacttctttgctgtgaaaaaatttcagataacaattaaagtagaatgaaaagagcagagtgctggttgaacaaccctcaatggctgcagctgcatggagtgccaaattgccctcccccaccccacacacaaaatcacacatacacgcacgcacgcacacacacacacacggagtttctcagcttctgtgtagacagaatccagcctaattattttaggcgggaattttaaaaatcctcaataaaattgggcttggtagcacatgcctgtaatcctatctagtaagaggctgaggtgggaggatggcttgagcccaggagtttgaggttgcggtaagcgttgatcatgccactgcattccagcctgggtgacagagtgagaccccatctctaaaataaaaattaaaaattgtttaaaaaaaatgcagtataggccaggcacagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctraagagttgttttactacctctggagctgagaggtgaacatagtcgtttttcaggaagccgtttctggctcagacagatmagaagctggcccacccttgccacttcctggaggactgtcagtgctagctaatgagactgtaaaagtggactatctgcccaggagacagygaggaaggaaatcaggggtcacccttayagsgaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaagctgaggcaggaggatcccttgagctcaggagttgagattagcatgggcaacaaagcaagaccttgtctctaaaagaataagcagaaaccaaaagccctaaacatgaggaaattccacatgtaaacattaatggaaaacatagaagagttgaacctagtggtaaattttacctttagagcaatgcttgaaacaagggaaactgtcaaattctcatcatgggatttgtgttcctttgttttttttattaaggacttggtccttggattggaattccaaacccatgaccaaactgtaatcatctaattctgtattgagtccttactatgtgtcaggcactgtagtaagcaacactcaagaatcttacagtctactttccaagaattcacagtctagttttggaatcaggtgatcaattgacttacagtctggtatggtgatgacagaggagcaatgtacagatagaacagaaggatggcacagtgagccttttcaccaatcttggaaggccagtaatgtcagtgaacactaggaatggtgtcatggcctgggtcctgaagagtggatacttaatgtccatggaggcatgcatttttatctgccttgcatggcttctttcattctctccctgacttccacccaaaaaatcaccatgatatccagctgtggaagagttcattatggagagcttcctggaagaagtagtccctgaactgggttgggctaaacaaatatgccaagaagggtttctggaagcagttgacaaaagatgagtagagagagggagggggtggtgctatatttattccatacctttcagatactctctaaatccttgtccctgttgtctatgccatgtaggtagagttttcaagtcatgtcccataccttggatcattggattctcaactcagtagcacctttgtgtgacacctcttctgtaataccttattatgttgaaataaagttagcaaataacataacttacatgcacaaatatattttcaattcgatatgatagctttactgtaatgaaagaaaaaataactgaaacaaaatggcgtgtgtttcaacatgtaaatgcttgggccaggctacaggaaagatggggatgtatgtatccgtggatgaatcaccttgaatggactctcataaaaaagcccaccattaccaggtgtgtggtattgcagactccagcaccaccaaccttgagtgaagcctgactatattagtctgttctcatgctgctaagaaagacatacccgagaccgggtaatttataaaggaaacaggtttaatgggctcacagttacacatggctggggaggcctcacaatcatggcggaagatgaaggaagggcaaagggatgtcttacatgacatcaggcaacagagtatgtgcaggggaattctcatttataaaaccatcagatttcgtgagacttattcactaccatgagaacagtatgggagaaagcacccccatgattcacttatctccacctggctctgcccttgacacatgggggttattacaattcagtgtgagatttgggtggggacacagccgaaccgtatcagtcaccctccaaaaatcacacaaaatctgaaagtgcttttattcattctacatgtaaatagttgttgcactacccacctggaaattcagtggatgtttctaggctcagataattatccacaggcttttcatctccatgagtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattgcttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagattttgccagaactcatcttggctttgtttacatttttcttttaaacgtataagactattgatggtacctcaccaaggttataacccctttataatcattaatttttaatctagaaaagagtcttggagacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatatatgttagagggtggggagagagttcagtatgtcaggactgctacatttatgagtgtgggtctttattgaagtctctctttgtagccaatccttttttttttttttaatttttaaattttaaattcttacttttagatatgggggtctcactctgttgcccaggctagagttcagtggcacaatcatagctcactgcaacgttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaaggagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccgacctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaastggacttcagtygcctctctscaacaaaaaacgactattgggcgatgctggcttataacaggtccaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcytagagaaacctgcacacttgtgtstccacctttttacctcttgcgggcatgagtctggtctcagtaatmacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaawctgtatctkwtgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatgsttttagtaggaagtaytttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagakaagggctttgtccctggccccaaagactcagggagaggtttactggccaggtagaaagggcgtccaggtgaagggaccctggttcagtgatctccaacctgcacgtctcatttgtgaggaagccgtagggtgtggactttycttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcrtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagygaccaatggatgtaagtaagttggaaaaggrcaaaggatttagaatcatgagggttgtattcaaactgcagcctctrctcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggrtcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtktsttatttaatgtctgtccccccttctcttgacagtggtgtttttgccttcacactactgtatccctggtccatacmgtaaatkttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcscggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacwtgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaagataaagaaatactttgcaaatcagctgagcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtgsagtctcaytctgtcaccaggctagagtgcagtggggcgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgtgtgtgtttcggatcccaggttccaaacctgctctaaaacttgttgctgcatctcacctaatcgtgtagtgagccaggtgagctcatctgtgaaatgcagacctttctggacgtaccacctcgtggggtgaagggaaagaaatgatacaggtgtacatcagggtataagctgtcctagagtctggattctttttatccagaagccattctttcagcctgtgcctttttgtaaataccataccccatctatttccacaaaggatttggggcattagsgagtaaagggggaatatgttctagaagaagggcgctcacctcagtaaattgatgggtgggccacaaaaatcatgtcacaagatcttgttgatgtgcatgcattcattcattcaacaaatattattgagcatctaacataagccgggtgctttgctaggkacagaatgctgtacaaggtccctgtcctcatggggaccgtatgttgggaagacagatgataggcatggaaatgaagagacaaaccactccgacttcagcccaggaaggagctttaatttgagtaattgttttcactaattcatcttcacagaaagaaataatatgatcaccttcggttagtaaacaaaacaaataggcaaacaggtttacaggctgaggtgggctggatcacttgaggccgggagtttgaaaccagcctagctaacacggtgaaacccttctctactaaaaatacaaaaatattatctgggtgtggtggagctttcctgtagtcccagctactctagaggctgaagcatgagaatcacttgaacccaggaggtggaggttgccatgagcagagatcgtgccactgtactccagcctgggtgatggagcaaggctctgtcttggggcggggggcagggcaggggaggggggaaagaagagaaacagctttacttacgtttttgatgagcctagcctttgctgtgctttggaaaatgggctgtggaatttggctgaaatagtcaaatgcgtagctggctgtatgtggactgataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctctgtctcccaggctggaatgcagtggcattttctcggctcactgcagcctccgcctcccaagttcaagccattctccartctcagcctcctcagtrgctgggattacaggcatgtgctactacmcccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgwaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaattagtcggaggcggaaggaaatgcaaaagtggacatttactcgagaaagaataaagaaaccatgcaggattccatttcacaaacctctacagctgttgctggggagtcagtggaggggtactggaggaaggcagactttgttctaagctacttagcagccaaggaaagcagaagaaactattattattatttattattattatgtgagttggagtctccttgtgtcatccaggctgaagtgcagtggcatagtctctgctttctacaacgtccacctcctgggtttaatcgatcctcctgcctcagcctcccaagtagctgggattacaggcacccaccactacatccagctgacttttgtatttttagtggagacagggtttcaccatactggcccagctggtcttgaactcctgacctcaagtgatctgcctgcctcagcctcccgatgtgttgggattacaggtgtgaaccactgcttctggcctagaaactattattaatagaagttctgggacaacggccctgctctcattacttgcccccaatccatgcaatgaaatactggcctgtgagtatgtggtcccttcagctcattttctgaagctgaccaaaggagcacagtaatgcataacgggggagtaaaattcctcaagacgagcaaaaaaggcagaaattaataaaactctatgtattagttatctatcactgcataacaagttacctcaatatttagcaggttaatacaatgcacattcattattttatagcctttgtagattaggaaccagccattgcttagctggaccatctgctttagagtctcacaggctgcattcaaggtgtccactgggctggggtcaacttcttaccgacaaagctggtgccccaaaagaatggggtcttatcctgttgggtgtcatgaagccaacacacaaaaccgaaagtagtgtcaagyagtacaggctttattcaatggccatggaattgagaagcaggagcatggctcacaaattcacaaatcagcttctccactaatgaggggtgrggaagttaaaatatagactttgttgttgktgctgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatwtgtaatcctaggatttgttgttgttttgttatgattttttttaagcaggaagctwaaaaaaataaccacccgttactttgctgcttttagaaaataggtttgagattgattttgaatactaaagtatagttttcatgttataaagccaaccatgttaaaaatgtataataaagtatctaatttagcaaaattcaaatttcccctatgaaatatcaagctctttttatgcttcttcacatggcaccttgtgtagaatttgaaccactttaaacattgcatccttgagttgcatatgatgggatctcttgaatcatttacattttgaaaaaagaaagtgaaatattctttaagaagccaaagtamtccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatwtttgccggatccaaaaaaaatactgtgtatsaactmctgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctataaatataaaagagcaagtaatgaaattaccatggctgaattctgaatattaacccagagcagatttcctctaagaaagatcataagaagatgcttaaaagaaaacattatatttcaaaagaattaggttctgaaatatacccaataatgaaaacaatacaattttcttctgctttttgtccttcctgttccaagcactgggaaggagctggcatatttcttatgtatgaaaagtagaataatatattggattcctttatccctaacccggaagagtctttcttggactgtggtttgctttcccgttatacttaagcttgtttattgcatcttccgatgtcacattatctcattgccaagctaaaggctctgttgggttcttagttgaacccagagtggaggccgatttcatccaaagccattttttttaaaattagaaattaaactcacctttggcaagtcctcctgaccagggatgggtcctcatgttagtctgtaatgtgaagatatgaaatgtatttgatacaataggagattcactgtgattttcactgaatgagtatacattctgcagaactagaagataaagataataaaacaattcacatttcttaggactaatttattttccacagtccactaccaacatggtgggatggggaggagctgagaagagcatatttggctgagtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggycatattaatgsaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagattttttcaatttttttttactgtcatatgattcacatgctagttactgattgctatcatgcagtctgccagcagaccagatggcagatcttttaattagatatgtttgtgtgtgtatgcatgtgtgtgtacatgtaatcacagttcatcaaggacctaataaatacttttttctctctctctctttttttttttttttttttgagacggagtcttattctgttgcccaggctggagtgcagtggcggatcttggctcattgcaacctctgactcccaggttcaagggactctcttgcctcagcctcccgagtagctgggactgtaggcatgcactaccacacctggctaattattatgtttttaatagagactaggttttaccatgttggccaggctggtatcgaattcctgacctccatgtgatcggcctgccttggcctcccgaagtgctgggattacaggcatgaaccactgtgcctagccttaataaatacgtatttatgtctttcgatctttttctgtttttctacattccgtttcccctatggctgctattgttttccagtgagctatttatatatatatatacatatttttgagagggaatcttactctgttgcccaggctaaagtaccatgtcaagattatggctcactgcagcctcatgagcctcaaccttcttggcctaagtgatcctcctctctcagcctcccgagtagtttggattacaggcacctgccttcatgcctggataattttttgtatttttgtgaagacgggtttcatcatgttggccaggctgcagctatttatatcttatatgtgtatttgtaaaaaatttattcctcagccctgtgtggtagctcacttctgtaatcctagcactttgggaggctgaggtgggaggattacctaaggtcaggagtttgataatagcctggccaatatggtgagaccctgtctgtactaaaagtacagaaattagttgggcatggtagcggtgcctgtaatcccagctgcttgggaggctgaggcaggaaaatcgtttgaacccgagaggtggaggtggcagtgagtggagatcacgccacagcacttcagcctgggcgcatgagcgagactatgtctcaaaaaaaaaaaaaaaatttcttattcagttgatttaagatggtttataaagacaacatgagctagcggtagaaatgcgaatggacgcttgtagacagtaaggactcaatacgtgggtttgttcaagttatattgtgcagacaggcatatgcagttagaaaatctgtctagggtagggagagataaaaccagctacttcagccctgctatttttatcctgaagattttttttttactctgtttatgaataaaacattttaatcagtgctgtatcaacactgatcaatttttttcatggaagtgtaatacagggtgaattccattaagtcaattaaatacttagatccagtttttaaacagtgcgaagatagttaagctcttcttttattgaaagcctttttaccaaaaccatttttttttattttatagtgaagatttcatgtatctgttttctgtacatgccaagttttacagctttttgtatcatgagttttcttttgcatcaattatttctaccaagtccaacttgtagattgggcagatctggatttcaccacacctggtttttgttgtcattgagtttttgtgatggggtgatttcagtgagaaatatatgccattaatttgatgaaaaatcagtatttatttattaactaatacccaagaaattccccagcaagcctcttccagtattctagagtttctcgtttcttgaggattggtctccgggcatactcctaatctaattgtttcccaaactttcaatgttttggatgactttggaagccttgatttctgtaggctgtagcaggacaaattctgatggacagatcaagatgttctatgttgctctaaaacagcatctctcaaacttttttggaccactatctaagttttttctgttaaaacccaatacatttatacttatgtatattcgtgtgtgtgtgtgtgtgtgtattatatgcatgtgtgtgtatttgtctgaaataaaagttttacaaaatgatacttttatctgagcagtgtcctgctgttttttttcccctaggttgtgtttttgtgtttttgtttgtttgtttgtttctttgtttgtttttgagacagaatttcacttttgttgcccaggctgcagtgcaatggcacgatctctgctgaccccaagctccgcttcccaggatcaagcgattctcctgcctcagcctcttgagtagctgggattacaggcatgcgccaccatacctggggaatttttttttgtatttttagcaaggttgttgatcaggctggtctcgaactctcaacgtcaggtgatccatcctcctcagcctcccaaagtgctgggattgcaggcttgagccaccgtgcccacctgtgttttttgttttgtttttgtgtatgtgccaatgatgacccagtttcaataccaactgttgctttcaccacccactattggtttcaccaccccgctagatcacagtctgttctttggcagtcactgccccaatactgtttgatgtgctcccctctgataaatgttcattgagtgccccacatgtcaggtactgacttaaggcatagcaaatgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggygtggtggctcatgcctgtgatyccagcattttgggaggccaaggtggacggatcaccagagttcaggagttygagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggctataggccaggacctgtgctatgtagcttatctatttctcatgctgattctacttttgttactaccgaaggagcttagagggaatcagtgacgtggacaaggctatgtaactaaagggggtggaggaggattcaagccccttgcaacggactgaagtgcccaagctctaaatccctgccacccacagcctctgttggccccaggttgtgtctgarattcaraggttgtttttatagcagcaacacagtaagttgggaagagggacacatttttaacatagacaccaaaagagaggctggaaragttgaccacttaraaatgtcacgagtgtctgtgaatagtgttgggggctgagaggcaagagaagaaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctctttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctacttgttctcttggttccttcaaagtaatgactaagtacaggtctttagatagagagctgcaccaaccaggtattgcttcgtgtcttccacgtacgtcctgagaaagcgaaggtgaatttcaccaattggtaggtggaaatagaaaaactgttgattctttttttcattcaccaatcttttttttccccaaatgctaagctttatttggggaaatcttaacagccgtttttataagactctgcatttacaacatttgtgggggctgcagaggacgcacatgaaaataacatgaactggccatgtacggtggctcatgcctgtaatcccagcactttgggaggccgaggcaggtggatcacctgaggtcaggagttcgagaccagcttggccaacatggtgaaacctcatctctactaaaaatacaaaaattatagctgggcgtggtggcgggcgcctgtagtcccagctacttgggaggctgaggcaggagaatggcctgatcccgggaggcggagctttcagtgagccaagatcgccctactgcactccagcctgagcgtgagactctgactcaaaaaaaaaaaaaaaaaaattagctgggcgtagtggcaggtgcctgtaatcacagctatccrgaggctgaggcaccagaactgcctgaacctgggaggcggaggttgcagtgagccaagatggtgccactgcactccagcctgggtgacaaaaaaaaaactttacctgggcttagtaagttgcctgacttctcatcctggagttcgkatccccttgtttctagaagagaaatccctcagatgtgaaggtgtgttccatgattttgycgaacttgccctacatactgttttattatatattctgcccacttctattccctgccaattaattaattgtttcattggtatagtttttttttttttttttttgatacagggtcttactgtgttattcaggctagagtacagtggcgtgatcacagctcactgcagtcttgacctcccaggctcaagcaatcctctggcctcagcctcccaagtagctgggactattggcaatgccaccatgttcggctaatgtttttrattttttatagagacaaggtttccctatgttgcccaggctggtctggaactcctgtgctcaagccatcctcccacctcagtctcacaaagtgctgggattacaggtacaagccaccatgtcaggccattggtataccattgtttttcttaaacatttatttattttcttatatttacagcatatgtggtcatttaaaattattttatagcatataaaastaaaaagaatataaattaattttttagcattaatattagggaagataatctgacatttaaaaatacatgtctatatgtgtatacatacatagaagtatatatataaatacmagtactagtgtctgctaataggtggcgccactttttatctgtgtgtgttgggggtggaatkagcatgtagaggttggcaaaggggacaggagactgtgggatgattagtatattcttatttggcctgggagggaaaaaaartctttcatttccaacaatattcwttctctgtgtcacctcagcatttaatttacttccgtcacaaaactacttgaagttgtcccaggctagttggtcctattaattacaacctagagggattctattartaaactaatggattacagtacctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactggatatttccgagtggcctacaagtggagcgtgatttcatctttcatcaagagaagcagcttttcctcctcttgtatccgttttcttccttttctaactatcaaggtcatgcggtatstgccattttgcatattcttgctttgcttcatgttttccttaaactctgtgcacatgaatatttgtggtatatggcttaattgtaagcgatcaggcatcaatggctttttatgaggcaaaatctactttctrcatttgcgtgtgccattattatagattgctgatgtttgccaatggatattcttggaagtcgtcttctggtttaaatgcagttaagtatttaaaaataataccagtgacatgtttgcatttacattcagcctgaaggcctacttgatgctgcaactgaaaaattgttagactagattttattttattttaattctttttgagacagggtcttagtctgtcacccaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagagrcggagtttcaccawgttggccaggttgttctcaractactgacctctcctcggccttgcaaagtgctgggattataggtaccccgcctggctgatactttccttagttgttttcagtgtaataacctgtcttcagtctactytwtgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatgggatccacaagatggagtgatctttacgccatcctcctgaccataaatactaaaygaatactctatttcagttgagtttttagtttgctctgttacgtgaggacacatcacttgcacctcagtgtgagtttgaaagtgttttctctggagaataattctgaagaaataggccctccagatatcrgtagtgacagggstatcagtaatgttgattactaagttcttgccacaggtagaagccatgctactgcacaagtttcatacttgaagagtggacatctgacacagtgttggtggttgttgaagtgtatgactwttactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatyctgtatttgacacagcccctcccagcattctgagtcaycgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtrgaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcaraaaccctcacaggtcacgcctgaataccttcaatgtgccccatgtaaaaatacactgcaagtcgattggacatgccctatgaattataccttatttatgatcgtcgagccctcccttttcccgtcatgctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagcggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacraggcagcgggcactggggcagccacatagacaacatcyaaatttttgttgctttcctgggtcttgccctgtccttactgtttcccttgggcacgctgttcaccccttaggacatactacagtaaccttttcccaccaccgtgggaggactgtgattttgtaaatgtcytctgatctctcctctttgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttytgtttgcaaatgatcacctggtaatttaagagggtgagctaaacttcctcmttttctagtatggacctttggggctcaggatgaggatgttcamtttgtactgctggtggagctgcctttccattaagtgagtctttctccaagggaacagaagtcttaggttgttgatctggckgtcagaacctaggacaggcaaggcagtgggctgttgtagagkagatgaagctgatcagagcacacccacaccagtgacaaccggtcaggacctgggaagggctctgacccattcatctgagagatgtggcatgaggaacactgagacctaatgcttattgcttaatattgtggacaagggactctgtgggttgtctagtactaagcagaatggaagggaaggatggaaggaagagagggagagacggagggagatggaggatgacagggagatggagggaggcaaaaagaaaaagggagaagkawagagaggaragaggggaagggaggaaggaaagaagagagagaaggaggaagagaggraagkaggcacagaggtagagaggcagggagataatggagatcctggccaaaagttaatgctccgtttctagtagtccacagaaagcaccttgaccaagtgactgaatacaaatcgtatcacaaactactaggatttcttgggtgcttaccatgtgccatatttccttgaatcttcatgacgatccttcaagggatccttgttttctaaagggtaaaggtgcaggttagaggctatgtcagaagcaagtcaggatttgaaggcagatctgtctgcttttgcccctctgtaaatccagagctgctgcctcatttcttacrttgcccccacccrtgcagcaattcttcctgggaggcctcattgttcatattcataaagggccccattcagtctcctttttggagaaatggccactgcaactctctgttctgacctggggggaaatgttagaccctcaataaggagaatcagagaaagaagaaataaaacatattactccattcccatacttctgtgaagaaatacccgagactgggtaatttataaagaraaagagatttactgaactcagtcgtttcacctggctggggaggcctcaaaattatggcagaaggcaaaggaggagcaaaggcacatcttacatggcagcagacmagaaagcgtgtgcaggggaactgccctttataaaatcaccagatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataycttttcattagtractcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtakggaaagcctgttaatgagtacawgtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatcgtgttacccaggatggtctcgatctcctgaccttttgatcagcctgccttggcctcccaaagtgctgggattacaggcgtgagccattgcacccggctattgggtacaagtttcctttggggtggtgaaactgttttggaactagaggtgatagctctacaacactgtcaatgtactaaatgacactaaattgtacactttgaaataatttatgttatgtgaatttcatctcagcaaaaagaggctaacacataaggagacatattttgatacatgtggcatattaagctgctgytgttgttttttaaatattccagctgcgtgcagtggctcacacctgtaatcccagcactttgggaggctgaggtgggtggatcacttgaggtcaggagttcgagatcagcctggccaacatggtgaaaccctgtctctactrtaaactccgtctctactataaatacaaaaattagccaggcttggcgctgggtttctgtaatcccagctacttaggaggctgagacaggagaatcacttgaacccgagaggcagaggttgcagtgagccgatatctcacctctgcactccagcgtgggcaacagagcgagactccgtctcaaaaaaaaaagcacaaaaaatttttttcttccatctgtatcacacagttgcaacgttgtagcatgggcaggaaataattgggttgtatgtaatgcccagtaaagtaaacagatcttagagagggacaccgatccctaccctgcatggggttattcacagagccatggggacactaaacgtaccttatctcttgaccatgcyattgattagttatgtgtttgcctgtgttattaataatgtatacattgaaaaatctatgtgcattatagtctttgatcttgtcatgaatttcaaagccaaagattccattttccttctttttaaaaaaaatttttcaaagaggtaggctggaagtaaatttaaaaattttcccctttctggcagagggcttttttctgatcaccacccatgttaattagatatgcatgtatgtgtatgtatgatgtatatacccatatacacwcagtctrtatatacwtgtatgcgcacatacacatattttaaggaragaattataaaatgatcaattcaagcttactatatgctagaggtgaggaatatttgaatacaagtcttatctagtagattaaaacagaaattaaagactgtagactaaggcaggatcaaaggacctcttttcattgttcttttattgtttattgacttcaaaaaagactttttagtttaaactgactgtaatgtctcttgaatggtcttttgtaaaatgactttgaaaactcggggataatgtcttcattaagtggagaaaaatcttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatacttcatacaaagctatgaagcatattggaagattttaggtgccctgtcttcctggatataaaatgactccaaactcagtgatactgatcaccctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacattttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaaccccacgtattgttgcaacggcaaaaaagagaattgcacagaggaacaccacctatcagagttcacactgagtttgcagattcatccttttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattayaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcasactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacarccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatrtaagatccataatgactcttgccaattagcaggctgctctcttccaagtggtaacccagggactcaagctcttttcatcttgtggctcagccrtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgatgtattgtttgtttaaaatcactttggattctcatttaccttttccccctcaagatctttgtttttgactttggagataaccagaaataactaagcatgcttcsttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcctcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgatygacctacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctggtattttcactcttccttcctaccctggatgctgatttgatgcttccagccttagcggtyttcttgcttctaggactgaacagggaagagggaaaagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgrttgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatataagcaatagtccctgaacatcatttggcctgaactaggctagagtttctcttaatcaaaataataacgatgatttttccatgccaaggagtggtgtcrtatcatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgttacctaattccaatgtttcactttattcagcgaagacattcctttgattattctggttaggtgttatgatgccaatttgcccacacattttttcttaggcgcctatgcttgcagtagacagagagttgaggaaagctcaaggttaaaacaggaaaaagtaacacagtaaatacctatttttgtgcataattcaaattaaaaccccaaccacctagaagcaccaatacaaggaactggctgcatattgcattcctgtgacctgctgtcttaatgatggaatgactaacgaggatcagagggaatgtggtcagcctcttatctcataagccaaatgctgcatattccaagcctgtcaattctgaaagcccttgttcatttttaaataatgaaaaactttggggccttgttcattgtttctaaaggaagacatttagaaaatttagaatataaatttctgttagtagaaactaatttctcttgcttttctctaaagtatacttgatttgaaatatgtgccctgaagttttgctatgttgaaaaaaatgatgagccgggcacagtggctcacgcctgtaatcccagcactttggaaggccaaggcgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaaaaaaaaaaaaaraattatgtcatttcgttgtcacagcgtcagcagaataaatcttagatcaagatgggattactgcgccactcccttcttcccagtctgtggtttagcacgggaaaaagcaaactagggcccttgggccaaatctgatctgcagcctgtttttgtgccgcctgcaggagaacatttttaaattgctgaaaaaatatgaaaggaaaaatatttcaaggtgtgtgaaaactacatgaagtttaaacttgagtgtccttaagtaaagttttataggaacacagtgttgcttatcttttatgtaatgtttgtttgctttgagaccgagtctcactctgtcacccaggctagagtgcagtggtgcgttctctgctcactgcggcctgcatctcccacgttcaagcgattgtcctgcctcagcctcccaagtggcttggagtatagacacgtggcaccacgcctgggtaatttttgtagttttagtggagacaggatttcaccatgttggccaggctagtcttgaactcctgacctcaastgatagacccacctcagcctcccaaagtgctaggattacagacatgagccgacctttttatgtattgttgatacagtatgacaagggaagagttaactgattgcagcaggttagagcacagcatgaagagctgacaatattgaccgactggccctctcagacaaagtttgccaacacccaggtgagcagatayacttatctgtgagcagacgtgattcaggggagattgttgtccctcctttcctaagaaaatgtggaaagatgagaatgttgccaccagtgctgatatggagcgttttttttggaattgtcttaaacaagtcccaaccttgactttgcctgtgtaccctactctttactcccaggtctttgcaaggtaagctgtcaggtgttagctgaagatacggcagcccaccagtggtcccctgaatgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaattttaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccgctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgacttycatcttgatggacaatgagtactcactctacttttttaktttatatttttattttagttcatttcatttaagacagcgtctgttacccaggctggagtgcagtgacatgatctcrgctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatycaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtsgatgaagctggaaaccatcattctcagcaaactgtygcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgtaacaaacctgcacgttgtgcacatgtaccctagaactgaaaatataataaaaaatacatattaaaaaaaaaagaactggagcatcgactttcgttttcatttcaagacccgtcccccatgaycacagaggatgaaaagtctgcttaaattataagctagctaattgcttcttcagttgaagacctaaatgagttttaaagtgaaatgcatatctctaagggctaagtagccaacacaataggcaattgagataggaaagactaatttagaaaaggttgttttgttcgtttttctttttccttccctcccttcctgatttcccatcttcttcctccctcttctctcccctctcccccttctcctttccgtccttcctccttcagttccctctttcctctttttcrcccttttatttaacattataaatacgatgggattgtgtctgcgcttttgttggtaattaaataaattatttatacatttaacacaatcttgaattaccaggtgatcatcttaggcactcaaaagcataagagcccttgaaagcaatatctaagcatagatattccatagcacgtcttacaatctaaatattgcttttagtgtaatcgaagcagcaagagtagtcacagcagttgatggactatttttcaaattgatttcaaaaatgtatttaaggggatgatcttctagtctagattacctattgatttttaatatgaaaagctcattatgtaagcagtaaccgcatataaaaacctagcaaacctttgcataaatcctttaattgaatttccagagcctgtggttctactttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagtgttcatgccgcaatgcacttatagcttgtgtgataggattatggaaaaaataataaaactaatttccaggggagaatttctaatgtgagattttattttttttcaatttgataattaatagtgaaatcatatcatatatataaatcatattttagcctataaactgaaatggcaattaggaaagataatatatacttgatgtaaaaccatgttacgtgcggataatcttttagcactttaattttttaattgtagaaggagagaattatgaattcaagtcaaacacattaaatggtgggtttcatccaaaaaatctgattcttttactatgtactgtattagtggatttataatattagtgggaggaagtataaaagatatggaaaaagatattctggttatgttcgtgctaaaatgtgtgtattagaattaccaggggaaagaaaaatataaaagctgcaataggtttttctattttttaatacctaacatttgttattttaaaagcaataaaatcccctaaagaaatattcgtaatcaataagaacacaaaatatggaatatattaactgagttataaaaatgtttgtagtatagcacagaatgaaaaacacagcaagktatgtacggtttaaagtgtaatcaattttgaggttgtatacaaggatatacatgataaatacaagtagtagcatttttagtaaaggctgttacaaaatactgtatttatggcctattccattctttttatagctcattaatgtagaaaacaaacacagtgtatccatcttctcagacggtttaaaattcccttaaatgatgtttttaaatgtaaataactgagctcatttgatctggttcttccttaagccaatgttagcatgaatggccatatttaccaccccggggttccttttcagactccggaaagaaaaagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattcttccaggccacaagggggccgttgagttastggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagcyttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcatgatggtatagaataagatattttcatagtgaaaatggagataagacatgtcccattccctagaatagactgtcactgctctcgttgcctccaaggaggaaactgttataggaatgattgacatggaggttcatctgtagaatatggacagccctctacaaattgggaacaagggccaggacacgaaatatagtgacagcctctggcctgggagtctagacagtggtgaaaggcaggattcatggagttttccaagataagattcaagacccaaactatgaatgaaagccaggctgaggctggcaccaagtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatrtaaattaattaaaattaaaagttcarttgctctgaaatagcagccacatttcaaatcttcwgtagccagatgtggttattggctaccwtattgggtagcaccgatatagaacatttctaccatagtagaatgctcttttggatasatctgctttaaagcattagtccccaaagtgtgaaggatgaaccamttgggttccgagagraaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccrtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcargacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaasttttgatgggaactttgcaggatgttcgtttgtttatcattagccctgggagagtcatccctcrcctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagasagaacctttccttacccaaagatttcgtaactttctcacatccttggttaaggctgagctgcctagctgtctgcatttctgataggttttgctttcatacacatttcaaggacttaagaaatctgtttctaaagaataacttagaatgtgcttgttatggtcccacctattctggggaataggtggatattatacatttatttaggtggaatggtgggtcagatggcttcatgtctttttacatcacagttccacagccctcattagtgaagcagaggttgaaggaggtcacttgctttttatcccaatgtcaaataactccataattttttttattattttttgagacagagtcttgctctkttggccaggctagagtgcagtggcgcgatcttggctcactgcaacctctgtcgattctccttcmtcggcctccgtagtagtcaggactacaggcatgcaccaccatagctggctaatttttgtatttttagttagacaccrggtttcaccatgttagccatgctggcctcgaactcctcacttcaggtgatctgactgccttggcctccgaaartgctgggatgacaggcgtgagctgccttgcctagccaaataactccattatttaagaaaaattaaccagtatttattgaatacttactgggccctgtgctaagtgctttscatgtgatttctaatttcctgaccattctatgaagtggctactataattatcctgatttcccaggcagagaaactgaggcttagagagttgaagtaatcaactgggtgttaaaaagctggtaagtggcacagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatkcatgagtgtgttagactgcttttcttctattttttaaaaatgcacccaaatgtaaaagacacttttacstttttgatttgatgttgaaggtcatttgaaaaatactctgtctttattctttgaaatggatttactctcaagaaagttgcatgtcactttacttggaagagacgggtctcagkgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacrctgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcamaagatactaattcwttttttcaaatgcagcatcgcttgaagctgtgataaaatatcacacctttggaaatcaaggctcttctkgtttatttatttaactcacattaattagccttaatttwaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatkgcttaccttactttttagacataatttttgttttctgttaaagggtcagttatagataagtatgctcccttgcaatgaaatgaacccactttatcaaytttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatrtattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacctggcaagrcacgctctgctctgccctgmcttcygatgagctgactaacaccttatagatgargttcccttagaaccaaagatgccccatgaaactccctaggatgaatgttggaagtccttccaactgggattcccagccggaaaggaaacagttcatctgactacagggtttaggtttacatgtactttaaaaaaaaaaattaataaagtttatttttacagtaattttaagttcacagcaaaactgagtgggaagtgtagagtttcatatactccctgtcctcacacatgcacagcctcctcyagctatgcacattttcaatgaaactacatgttcattgaaaatgatcttttgggtggttgatgttcgattttggctctgtgttgggcctgcccagtgaggtccttttgactccctaaggraccctgttttgggtttcttttgaggttgaagatatttcagactctttccccctcaacttccataggaaccaaactctctttmttcctcccgtttggttggaaagttattttgcctcactgcgtgatttttctactgcaccaaytcccctttcaaacgttattccacaacatactaaattaatgtatactgtgttctttgggtaatggggaggggagcctgtctcacagcacgcatttgttcagctctgtgttgaaagagcactgcccgccgcgtgaaggacatctgctcacaagtgagcaattgtgcttctgatttggggcagcacctttgcttgaacgctggctccagatgaaagaacagattgccgcggagccgcttttccaaggatccctctccccagcatggggcttcatayattattgagagcaaacctactttccaccgccactcctggatgcacttattttgcgagccttattcagaatgtcagcatggatcacttggcracaaaggcctaaagggcaagccaggaagcttccatggatacgttatttatggtgtttaattattattgtacagatttattaaatgactctgttacctaggagtccatgtagttgctgaaaagagtttgctaactttgaatcgtagatgttttatctgaaaacaaaatttccttgtgaatgctgttaccatattcctggtgtctatgtgagggggtgtgtggtggtatgccggtaagtgttgaacaacctgctctgttggcgggarctaggggaaacaaaccctgttttgtagtatttgctgattactgtggtgtaaatactcacaccttggctgatttcaagttgcagcttggaacttggagttrgaaagagatgygtagtcccataccattttatgtatgtaaagtatttgcactatgccgactaatagacataaataacctcatgagcatagataatagtcacatctactaagattattcagaagtattgagctttgagtatgttttacctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttgaaacagtctcactctgtcgcccaggctggagtgtagtggtgtgatctctgctcactgcagcctctgcctcctgggtttaaggaattctctgccttagcctcccgcgtagctgggattacaggtgcatgccaccatgcccagctgatttttgtattttcagttgagataagsgtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcytcccagaaaaagtagatgcatcagcagagttgagcccctgggcattatttccccaattccgtatcccatctactaatacaaactaatgagatctattaaggatgagtccacaagtttgaagggagtctcttaytaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcrtttgtactgggcatctgtcctgtatcttggagatgtttagtaacatccctgrcctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagrgatctcacaggaaacttggtaatgtagattttggaggacttgaaaggttcctgctacctttggctggggatggagggaacatggaagatgggtctttgtttagaggaagctcttyatcctggtacsctrgaagttggcatagtcttagcagttagtccagatgtgaatttcaggattattctgtgartcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgrgtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttcttyatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtatctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgagrttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacattygtgagctcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatggaaatggctgtggggcgcctgaggtgggccctggcatgatggcaagttgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaaygatttgttcagattggggaaaaaawttttttttttttttttggttgtggtggcgttggcttttacttggggttgacctttccttatcaaggacrtacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggayggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagtycgttacttagactaggaaatggctccgagaagctcacccatcaccatttgctctactgcaaaacaggactcattagcaggagctcataaaatgaaactggcagtgagctcatatggaagargcatcacgggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtyagctsctacaccatgagtgcttttgtatsgtgactgtctggttacaaggtcatcttttcccctggatgagacgccccttggggaaaggaccaagttttattycctgtttaaccttggcctgacaacctaataggtgctcagtgaacagttcttgaatttaattctctccctttccccacactgatgkgtatttaagctccagtggtactcgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaagactcccctttacacattgccgttcccttgccttctactcctcttttcattacccttatcaagattctgcagcccagggtgctgcttgttgatggacatcttcacctgactttctccctggtccaggtgcattttaagcatggaaggtgacacttgccattctcaatggacaaagggagtggggagtgtgggggtgtgctttggrgttagtctctgggttttcgaaacttagcattctcagattcccagccaactggtttcacatgacaagtaaatgagcaacctggaagatgagtggcgtttccacacacagggaagcagatagttccattasgtgacagtgtgtgcacagtttatggaggatgaagcggaaaacctgagccacaakgcagtakaggttggacgagacactcattccgaaggsgggtgtgtatgtgcaaactgtataatttttttcttcttttctatctgctagcaaagtggrtaagttgacccatgacatsgtccactggagggaccacatttgtgactctagcaattaagcytcccttctcatctgtggataaaactgacctcccagtgtgctggagtcaaacatattcagcatccaatccacattggactgtttgcatgtaacgtacagaacactcattcatctacatctaggaccataacagcgagcaggagacagtccctgaccctggggactaagcccaggacctgccactaggagatattcatggaatcactgtttctcctccttttcaaagaagactgaatttatgatgaaactttcttcgtatattggctttgagaaattctgttttggtgcttatgtgctctggataattctcaatgactttcaaagttatgattcagggagtaattggttctgagagaatatgcataatcacatcaaggtgtgtttgttttccaccatttgtagccttttgacaaatttctgggggcctcatgcctgctaggccgaatacttgtgtcccttgagcctggagacggcaagtacccagtgtgcatgcatgcactcccaaagtcctttattcacgacagacatcactaatcaatcagtcatgcttagcatactactccaagtagtcattactaatcatctctagtcagcatgggagatactctttaccatcccggtaaagtgacgttttgatgaaaacagcatggatcttcctgcagagaacagactagccccctgtacagcacacaactcggggaattttaggtytggtgatttactgctgttggagcctggccttcttcctgggagaaggctsgaaaaacttcawgtcagttacttaatggaataatacatgtttcctgcttccattgtcttcctggacctgacactcactctttaaccataagcagaagacacatacamaaatgtcctatgttaagaatctttatttaagacaggtggctagcattatttgggtccagaagcttccctggaaagaaaggattcactgcaagatcgacaggcttacccagttcatttaggcgtggctcgattaatgcacacaaagctttgggaacatatcagtcacatcaagctaggtccacctgtgtgagtaagtaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgagaataatgagctaatatgtatctagtaattgctatgcacttatatgtatagaagcgtataatccacagcactccttctgaatacgttacgtaaatggaaccctcgcaacagtcttatccccattgtagagatgagaaaactgaggcatacagaagggatggaactaggccaagagcatagaggtggaattgttgtgtgagcctgtagagtccgtgttcttacccactgcatgatgtctgatcatcgtcaattttctttccatttggacagatgaatggtaacacttccctactaggtagagcaatgattccagaagtttataataattggaaagtgtattagtcgattctcacactgctataaagacattcctgagactgggcaatttataaagaaggaaggtttagttggctcgtggttctgcagactgtataggcttctgcctctcgggaggcctcaggaaacttacagttatggcagaaggtgaaggggaagcaggtaatgtcttcacatggctggcastggaggaagagagaaagtagggaggtgstagatgcttttaaacaaacagatctcaggagaactctttcacaagacagcactagggggatggtgattagaaagcacctcatgatcccgtctasttcctgcagagaacagaytagccccctatgcagcacacacctttgtgaggtccctyctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaaagcattaagcaaacaaaaggaaataaaaacggcaacaaataaaacttctgtgctttttgaaattytgtttttggcaggcaacattccaaagatctttttcatttaaagtccaggagtcttctgtgtgaaccccacacaggtaccttggaaagactgcatctcctggattttgcatggttctggcttaatggacaacatatcagtcattttttgaggaaaataaatttaaggcttggtyatcggtccttgagtcagcacattgagcgttttgtcaattagctcctcccccmatctktatggtatggcttttcctgtaattacagtcaagatcctatagccggaggaaggcctgtcaattgagtaagaggctgatgttcatcgcacagtgacagcccattcggagggttttaggcctgtccttagagaggcttgttatttcctctttcggtactttgttgcaacctagttcaccgccatcagatgaatggaggtttcttatgctgtggcgaaacccagggggtcaagcccctcggacatgacgtactgcaaagtgaggatgtttcattgatttgtatttttaaaattaaaaataattatttaagctgcatctgtgtgcttataagaaaagatatagaaagattagtagtagactgttgtgttctttttttttttttttttttttttgagatagactcttgcctgtcgcccaggctgcagtgcggtggcatgatctcggctcactgcaacttttgcctcctagattcaagcgattgtcctgcctcagccttctgagtagctgggattacaggcgcccgccaccacacccagctaatttttgtatttttagtatatacggggtttcaccatgttggccaggctggtctcgaactcttgacctcaggtgatctgccctccttggcctcccaaagtgctgggattataggcgtgagccactgcacctggccagtagtagacttttgatagggtttttttttctcaaggtgtaggtttggctaggaagtcatagaaaatgctctttttttttttttggagatggagtctcactttgtcacctaggctggagtgcagtggtgtgatctcagctcactgcaacctccatctcctgggttcaagtgactctcttgcctcaacctcccgagtagctgggactacaggccaacgccacggcacctggctaatttttgtatttttagtagagccggggtttcaccatgttggccagggtggtcttgaactcctgacctcaaatgattccctgcctccacctcccaaagtgctgggattataggtgtgggccactgtgcccggccaggaagatggtcatgttttactttgaagcaatctgtgcttggtttatttttttcagtgagtgtggattacgtttataattttcagttactagttaggtaaagaatcaaaattaataaacacatttatagttctcagagattccttgagagaggaacatctttaaatggataaccacagtcttctaaacacctgaaagggtgtcttttgctgaaytatggagttttagttttgctttagaatttttggatgattagacttgtacttcttttaggctatttttccacctggtactatttggctttactgamtgccctcattccccatacaccaccttgttttgttcagattcccctaartcttcattctcgtcccacctccccatcactcctgactacttgaaacacgacttctgtcctcagaaggcagcagtgttccctcctcccgttcatttttcattttcccgttgcttaaaaaaatcaagcatatgtttgcagtcatcactgatgttctgcctcctcttctaaagttatagatgagtgccaagttggcagagcatgtagaaagatcactgcagatgtccttgtcgtgttgaccttattggagaatttcctatctgtgatgacctgtaaatggaatttaagggaggaatcamacgtgttagcacggggttggcattgcgtggctgttttcaattaacttgaccactatsataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatgggaagtgcattgaggaagaggccccaagacawggagaagtcactccaactttccggraacmccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatstctgctcatgcttgagagtggtggtgtttggaaagactcaatagcatatgcacatgaggaagttgaccaaatgattccacagcrcatactcattttttgctctgattctagcttttcctccaattttattcagaatttgttcttttcttacctcacaccatatagaaaaatcaactcaaagtggattggagacttaaacataagatctgacagtgtaaaattagtagaagaaaacaaggaggaaagctccatgacactggtctgcacaatgagtgtttttgtatatgaaccgaaaaacaggtagcaaaarcaaaaatagacaactgggattacaacaatctaaaaaayttctktacagaaaggaagcaatgaacagagtgaagcagcatcctacagaaagagagagaatatttgcaaaccacacatgtgataagggattaatattcaaaatgtacacacagcgtaaatgcaagaaaagaatctgatgtaaaaatggcccttccaacatctagcattattgtgtgttgaataaatacttgttcgattaggtctaatcactcttcatgattggatttccaaaatgtggactctcagcagkacattacagggacagtggttgggtctggagatgtcacccttagctgtttttcacaatgagaggttgttttatcataaataaatcaataaatggcagattatacaccggagttactgagaaatataaaaaaaaaaaaagcccacattttaaagggaatttggtatttttaacaaagcatcagggggccgggagcagtagctcacgcctgtaatgccagcactttgggaggccgaggygggcggatcacaagatcgggagatcgagaccatyctggctaacatggtgaaatgctgtctctactaaaaatacaaaaagaaattagctgtgcgtggtggcgggcgcctgtagtcccagctactcgggaggctgaggcaggagaatggcatgaacacgggaggtggagcttgcagtgagccgagattgtgccactgcactccagcctgggcaacagagcaagactccatctcaaaaaaaaaaaaaaaaagaaaagaaaaaaaagcatcagggttgtcaccatgaagcaggaggagaaaaataatgctgttagacttcttaaagcgtattttgtggtttattttattgctctgtaaattgcaggctgtaattcatggggctcaggccagtgatttcacagttgatagaccaggcacatctcttcccaccccttccccacctaggggcaaggttttcaggaagagccccttttctaaaccacacatggcctgctcacaaatcttatgataaaactctacccactgagaagcacaaggtgtgaggctattgatgaggagttgaaggtgacagagactgagaaagggctgcacacctttggcctaaagggtaatgagcaacacacaaggattgggagatgttcatggcaagaaaaattcasaagggacattgttgtttcactaattctgtaaaggagagcagcggcatttacttakgccgattccccattctctctttctgtttttaaacagagacagatcttgctctgttgcccaggctggagtgcagtggcatgatggcatgatcatagttcactataatctcgaactcctggtttcaagtartcttcctgccttggsctcccaaaatgctaggaatacaggcaggagccactgttactggtctgtttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgsgggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctmagtggtcaggtgggactcatggagattttccgttctttggmractagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttctyccttcctccttttcttctttctttcyttccttccttcctttytcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggamggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctttctctttttttttytttttttttttttgaaaaacttttttggagcagcacctgcatgttgtaaaaacacaaaataaaaaaaaaataaataaaagcagaccccttggttcagatatctttgtttgtgtaaatgttttggcattctttrtgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctgsctctctttcaaactgtactgctcactttgggctgtacgttagaaccacctgagaagttctttttctttcttttttttttttgagrtggagtcttcctctgtcacccaggctggagtgcagtggtgggatcttggctcactgcaacctctgtctcctggcttcaygccattctcctgcctcagccttccgagtaactaggattacaggcatccgccaccatgcttgggtaatttttgtacttttattagagacagagtttcaccatgttggccaggctggtctcgaactcctgacctgaagtgatccacccacgtcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagtyaacgtagaaggtttctgggggcatggacctgagtcttatcccctttgcaaaagtaagaattgtatcgtagcctgactcagggttttagccaacttctctggatgctaatgctattctcttctttatacttgtcttccytcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcgtttgatgacatgtcttggcagtgatgtctatgacactgggcaagtgtcttaaaatgttgtgcatcagaaaaaagtcatcattgccaaggccagcagatctcgaaaagggggctgggacacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcytcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttgtcagaggtgcatgctgagagcatgatgggaagatggagtcttccatccactggtaaaatctggaatctgctctcatttcattttcactgaactgaaaataaggtaacagaccctcaggtctacctataagtaccttccaactgttccacttttgtaaatttagttcarataatacatatgctgaaattcctatatcccccccatactccagatcttcaktgtggaatttaaatataattccttattgtaaaaaaaaaaaawttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataactgaaataccaggtgtatagaaatgcatctgtggaaaaatgaaatcatrtattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcrtacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatstctgtgcatcagggaggatgggagaattaattccagtttctcaattgcaaaagtgaggctggtcatggggcttggaaccacgccacggacgcatgaagcctccccgtttacatgccaaatccagagcttakgcatccrtgctcagggctctctgtggtaggcaacagctggattatttactttctagaatatctcgagttcttaatctgagcagtttcgaaaccaarcccacattaattaatataaataatgactgggaaacgttgcaggactccccggaaaagaatgtataarttgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcctcagcctctagaatgcctggagtgagaaaacagaatattgttcttttctgtttatattatttcatactgagttaayacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcragcactggatacctagactctgctgggctctagagaagtgctgggctacagcgcccagtgccctacctcttggggccagccagcctcaccaaaaaatcasgcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatstgattctgtagagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagcccctwcccgwcccttgcacccctggatcttctgctgagtatcggattggtctgcgtccaagagctcctcgcttggccagcaggggctgcctggagaaggggaggacaggcttcgagttttttgggtagkgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcctactcacatgtttatggcccggtgagaccgcatcctccctttctctatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgttttttttttttttgtacagagtcttgctctgtygtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccrcctcagctgcccagggtgctgggatcacaggcgtgagccaccgtgcrcgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaaataagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcatwttacagctctggcatttctgggkaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattagaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggcctttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctaracctcacacccagtccctattcttaggttttatttctcaaaccaggttttgcctgagaaattacagcaaatgattcakagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaagaaagaaaaattagctggcatggtggcacatgcctgtagtcccagcttctggggatgctgcagcgagccatgattgtgccactgctctctggcctgggcaacaaagagagatyctgtctccaagtctgtctgtctgtctgtctgtctgtctgtctctctcggaaatattccttcagtgtattagtaaagaagttacttakgagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatgcttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgataycaccattgaggggagcaagatgacatgtgcctaccccacgtgtccagcagcaaagccacctggcatagtgggctgctcagcgtgcctggttcatactgcgtatttatagtcccagggtgttttcagagagtaaaagtcctttatgattagcaaattgcaggtcctcccctttctgatatttacagcccttgcaaccgcctgtacaaaaatcgggaaaaggcagaagmsggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtattacagaaaaggaaaaagccatatacatggagaaraaactcccgatatttaatattatcaattgctggttcctgtaaatttgcatttatggatcacattataaaagcaattactcttatggattgttcatgcagaaatgcaytatgatgatamtatacttttaaaagtatatttatttccagaattcaatttgtaagaggtttgagggaaaaataatactgagttttgagtgtttctgattttaaaaatgtgttcagtagaattaaacgtgttcaccaaaacccattttatcmctttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttactttkcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttcaaagatgctaaattatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcawgtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacrtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccrttgagtgtgtgcatgtacaactgcttgaaaacagcttgtgagttcactattaggtccatgaaatttttctccttggcaggttttcactattartttgcttgacaaaggatagatacattttccatgtgtggaggtaaaagcagtgcagtgagctaaaaagttarcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggctkgcaatttattattaagtggaataagcagtttaaaaacagtatgtacagggtggttttctggctatataaacacacaggcatwgaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagcctggccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatastattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctactttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggacacktgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctastttttgtttagctgtttttctaatttaatcttrtacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaayctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatsccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgwtgttactgctgtaagccactttcttctccctctccrttaaaatgcaacttaattggtaaagtttagttgactagagatttcatttatttatttatttatttatttatttatttatttgtttrtttgtttgtttgagatgagtcttgctcttttgcccaagctggagtgcagtggcatgatctcggctcactgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggtttttttttttttttttaaagaatgcgttgattttgtttttctttcttttttttttttttttttgaggcaggccttaggtctggcacccaggctggagtgcagtgacgtgatcaaggctcactgcagcttccamctcctgggctcaagcaatcttcgtgtttcagcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttcttttttttttttttttttgaaatggagtcttgccctgtcccccaggctggtgtgcagtggcatgatctcggctcactgcaagctctgcctcctaggctyatgccattctcctccctcagcctcctgagtagctgggactgcaggcgccagccaccacgccyggctaattttttatatttttagtmgagacggggtttcaccatgctaaccaggatggtctcgatctcctgacctcgtgatccaccagccttggcctcccaaagtgctgggattacaggcattagccaccacacccggcccarattttcttataaagtcaaatgggagatacttgtttgcargaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaaratgcasactgctttaaaaaaaaaaaaaaagggcaaggggaggtgtgagaagaaagtataattctttttcttctaackggagatataaaaatcatataagcatgatttatsatttgattggaacattgtattttatggttgcagagcacaygtatcatcctatctgcttctgacacccagtaagcagctctggcttttataattttgatgaaagargtttcccaacagtatttcggtgtgcatgctcacacaccagccctggtcrtcagtgaacagattcttccaggtcttcattgtrgcggaagaaagtgagatcagagatcccgaggaagggcttcagtttcaccagtagtggagctagggagtagsggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagckagggcaggtgcaatggctcaygcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccarcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttstatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgytacatttaatctttatggtagcctcatgaacaggytcttatttagttcagtggttcttgatcaggagtgatattgcctgccagggaatgcatgtcaatgtctggagacatctggggttgtcagttcaggagggtagaggataggggggaaaaggtgctactggcatctagtgggcaaaggccagggatagtgctaaggatcctgcagtgcaaaggascatgcccaccacaaaatatcagcagtgccgaggttgggaagctctgtgccattgtgcaaagattcaaggtggctatgtcacaggactggtacatgtccttttttttttttttttttttttgagacggagtcttgctctgtcgcccaggctggagtgcagtggcgtaatctcggctcactgcaagttctgcctcctgggttcgtgccattctcctgccttagcctcccgagtagctgggactacaggtgcctgccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaacctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttargtaggggtttgaggaaaatgaaaaggcctattkgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttccttttkcttttcttttctttctttctttcttttttttttttagggagggtctggctgtattgcccaggccggagtacagtggcacgatcttggcttactatagccttgacctctctggctcmagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccgtgggctctttytggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttcygtgttgatgaagcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaaygaggtctcatgagcaaattttaaggatggcaratgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcatartaatttttaacattgattgagtgtrgataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggaggctgaggcaggtgaatcacttgaggtcaggagttcgagactagcctggccaacatggtgaaaccctgtctctactaaaaatacaaaattttttttgtattttgggattcggtttaggtgatgtgtgtctgtaatcccagctacttgggagrctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaatawctttttcagtctctttctccctttcccaccttcccaaaagggtgggaaatttttaaagtaaagtaataaacaaataagttttgggttgggcrggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaamtgtatttttgaaggagttkggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactrtattagtctgttttcatgctwctgataaagrcayacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccrtcagattycttgagacttatttgctattgtgagaacaccttgggaaagacctgcytccatgattcarttacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcactttygggtcagttgagtctaacataggggtgtccaaacttttggcttccctgggccacattggaagaaaaagaattgtctttggctgcacataatatacaattgttgatgagctaaaaaaaaaaaaatycccraaaaatctcataatgttttaagaaagtttatgaatttgtgttgggccasattcaaagttgtcctgggccgcatgtggcccaccagcyatggtttggacaagcytagtctacaggttcttcaagaggggcttgagcatttgaaagacttctagtgggagagatcacaaggkacaastagaaaatcctgggctggcctgagaggcagacctgtgattattttgctctttgaaagttgtccttctgcacccattttccccagacctaacctcgatttgtgctccaggtctgagcagaaatgttattccctccaraaagccttcccykgatgttgagggatgaagttgtagscccctcccgaatgcrtcctcagaactcgctggttctcgtcctcgccctcagcatacttgctcattgtttgtttccatctctatcatctctgtgagccctttgaggatggatgtgtgtccatsttgttaacagttggmtccccagtaaccagtacagtgccagatacagagtagtaaccctacattstagcgtaggcaaatattctagtatttgccaaaactagaggatgaatgagtgatgggtaagagagttctcagaaaaatggatataaacaatattgtaaatcatatttggaarataaataytagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaaycctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgrcattttggcatgaytggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttattttattttattttttttgagacagagtctctgtctccaggctggagtgcagtggcacaatctcagctcactgcaacctccacctcccgggttyaagcgattccmctgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgygtagcttcatcatagatctcarcttaaggacaatgaaagtcgtttattgagtacttagtatgtgctggttgcagagccaagtcttttttttttttttttttttcctccttttttgagagagagagtctcactctgtcacccagactggattgcagtggcacaatctcaactgactgcaacstgcacctctcaggttcaagcaattatcaggcctcaacgtcctgagaagctgggactacaggcatgtaccaccacactcagctaatatttgtatttttagtagaggcggggttttgccatgttgtccaggctggtcttgaacacctgacctcaggtgatctgcctgcctcagcctcccaaagtgctgggattacaggggtgacccaccacacccagccagagtcaagtatttcaagtattagagttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattamtgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcartggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccmaaaaaaaaaaaaaaaaaaaaaaaaaagyggggcaaggggttggagaatgttcatatcacattattttggatgtctggggttgcacctggaagctcagatagcaatatctaggcacggctgccagygctctatacattsacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgcctttgtctgtagcctgccctcctctttaactgaacaccttccagacgagcatgctctgaactcctgaactgstcattctgttctctgagagaattgctcaagctgcagtttatcattatatgcctccaaagactttgtgtttcctrtgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagstgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagarcatgttttccctctaaagagaggcagctsataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatcmgathcagtacatattyakaaaaccacacttacatttaaatacaggcctttcccatttcacagtgtttctagctcccctttccaatacatctctctctctctttctctctctctctctcwcwctctcamacacacaacacacacacacacacaccgscaaatcagacaccaayataaactgtagagttaacattctttttccaccctcacactttttttagctccgatctgtgttcaatttctgcctgagagagtgawatattcatatatttaggtatagttagaaaaagcaaaatggtaacaatagaatcttgatgggattgatctcctgcagcaaggagcaacagaaaaaaaaaaaaakggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagwgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagcctcactttgctgcctargctgatctaraactcctggcttcaagtgatcctcctgccttgagctcccgaagcgctgggaccaatagagatttctctgagaattaggtcccccactattaataaggtcattgtcagctgarttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactytgggaggccgaggcgggcggatcacgaggtcaggagatcgagaccatcccggctaaaacggtgaaaccccgtctctactaaaaatacaaaaaattagccgggcgtagtggcgggcacctgtagkcccarctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtatmccmaaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacraattgttcatcaggtgtatctccagccctycgtaaacactgccggatggatgaacctacgtaatgatctcctggtgccattttcctgactgtagatacttgggtaaggaggagactttgactctagatgacatgatgtaccctgtgttctgcaagctggagaacatcatgtaraatctgaaaattaggagagagaggcaatcagaaraagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttyacatacagcgagaargattaagaggtactgwattgktggttrataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaacccycagttgtaakggaggcatcaagactataagayccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctttcaccaagcgctaacattatattaattattaataaaatccaactccttaataatacwatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccatttttwaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaacaactacccaaggcctgttggaatgtctgccagtttcaacccacggggatagggtgagatgaacattgattgagcctttacatyggagacactataacaaatgctttgygtacatcagctctttcaaattaatacaattctactagaggggrcactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgctatgtcctcatatcgkgggaggggcaaagggtctctctatctggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaattcaacwtacsaattttgcgaggacgcaaacatttaatccgtagtactgatgtggatatgatttgagctaagactctgctgttgattctcttcaaaaacttggcagtagcccttggatcccattaattgcattcaacagkcatgtattttattaatttttgttcctaaagaaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcaratatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcaragaaagttggatcgaccattaatcatgctatctcgacttctgtgtgtctcctttttgtccatctcttaaatcagtcacttggcagcagcaagacatgtggccactccagaccawttgatcgaaragctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaascctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgkcattaaaagttctcactggatcattccatttatactcagarkaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaawtcttgtcaaatatcttactcctgggctgtgctggggatggcagcagagtggggtggttggatggraaggcgggaaagagctagcttggagatgatacgcttttccayccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccastgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgkttgctcttcgcgcctgtgctttgaatggtgaataccctcggcgggaggcaggcacctgatgccactgcccccgccccacctgcccccgccccgtttctcagatcacacaggcaggctgaggagygcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttamctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacawgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacagrtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaasytttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagtygttccacagatactttgagtgcagtacaagttggtaatgggtaacaggctaaaccatgtggcaccccttccctcttatcagcttcttgctaccatgcagaaaagtgctgaaggtggcctgccytaaggcagtagcactagagcagggatggggaggacttgstggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacytagcatatgaaaacagttctggctgatgggttggtagaarkgatagatatagatacatayatacacatatatgcacagtaatagatataggtaaagaccttgatatatgtacatatattgtatgatacatatccatgcatatacgtgggtgtacacacacaggtacacacaaatatatatgtgcctttggacaaraaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcatagrcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccactttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagtgcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaakttttstattttmaatagagatgaggttttgccatattggtcaggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtsctaagtgagaagcagagatgaaaatgtggaaggatgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaacmttcagtctgagttgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctytggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttratcgtgtgmatgtattgcagaaatggacaggrcarttctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattttgtctgaactagccaaggtctctggwgtttgctgttatmttgcttcagagaaattagtgacattgaaaggctgttgtcttttttaktgtacttttggttgttaggagaaatttacaaggccatttttttctcccgtctctgcagttcaggagattatattagaaaatattctatacaaaaaatatgcatagtagggcttttctccagctagtagctcagaataagtcaktaytactgaaacaggtaccttttgtggaattgattctgaaatctgtttggatctgaaatctttctttcttgcctttgagtaagayacggcagagaaaaacaattacactagctgctggtctgtatttactggttagaatagaatattattaccatcaagaataacattagtggccaggtgcggtggctcaygcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattrtactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttgggkacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagytccsagaggcaacccacattccttgacttttggccccctgcatctcaaagccagcaacagaaactctcttgtgcatggagtcccctcctgctttgaatctctctgactttccttgactttgatgtytaggtytggatttcaagggytcagaaactctctcatgcatgtagttccctcctgctttgaatctctctgactttcmttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctstagctytyacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccytaacctccyaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatygctcccctgaatggaggtgaaagcatgcaagctmggagttaagatctttaactcagggaagaccctgtctatggaagtgctgagctcttcagtgtcatcacagaaaagcatgagcscctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttmcttttattttatttatttmtttcttttcaatackctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagatdccaataattaatatctwtggttgattgtaaaaatggccaccaattcttccctgtcccctgcayatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttytgggtgcgaacaarcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaaggcaagtagaaaacgaaaacaacatcaaaggatacactacmcaattgttggagccctaggamccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcastctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagtagagaatataagctttatccagggggccactcagtgatgggagtcttccttatgaagctgtcccagctccatctctcaggactgaaatgtgggtaagaccatcacatttttcatcccccgccccccgsccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgsctgcctgaggstctctttctggttcccagatggatgcctttgtgtgtcctctcatggcagagagaggaaggggtctggaacctttctcttataaggatactaatcccatcgtaccccgtcccccatgatctcawttgaaattagtcacctcccaaagccccacctccaagtactgtcmcactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgytgccttgggcctgtggcttytcctccytgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccrgggtggtctcgaggaggcccattaccggctggagtgacagagtgtgtcaagcctgcagctcgtcccgtgtctaatggaacagaaacaagcaccytgctgcccttgttttccagtggctcaccggggctytgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgagggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctccgcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctatcagtagatgcatctaataatcctaacactgtcatccttatacttgaggtcttattgtccacttctaccttagctatgtwaacagatgagtaacctactctggatttacccagatagtgctgttaggcaccacacacgatgagattggaggcacctgggtgtcagcctcttgggctggctcattacaggccactctgtctgaggaacactcaggtttgcaaaccgkttcttaaaatwacaggatacctagggacctgttggggtgggwgggaagaaccctatgggcagaaatgtgactttctgtagcaaagatgtactgtttcccactgagaagawtcaaaaatagaaaagtgcttccttgtctytctatattgttattaaaacaagtagatgcattttcrttgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgyrtgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttacataggagaatatatacagtatgattcaatttatagaaagcttaaagtataggcaaagctaaacattcaggatatttgataaaactataaagaaaaccaagggaatgaagaatgcaaaatatgagctagtgttttcccaggtgtgagggacggggcatggttgggaggaaaacagaatggtgccatggcgagagatacacaggggaggtattggaaagttctgtttcttaaaatgagtgacaggtacctaggtagtcattctatatgttattaaagtgtacacacattgcttatgtgaagtcttgttatatgtggcacatatcacataatctgaaagaatctgcttcctgtagtaaaaattaaaaaaattatagccgggcacggtggctcacgcctgtaatcccagcactttgggaggccaaggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtrtcagatacttggctgttttgttttttcttctwagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgctgactgttggctgttggctggaggtacccctcagctcctagaggcatcaacagttcctgaatatctgggcttttcccacaaagcagcttccttcatcaagccagcaacaagagtytctggggcaagttggtcaacaagatggtgtcttacatgcccaatgtaatcatggaagccatgtatacctcatcacatttgccagatttctgctgattaataccaagtcagaagtcctgcacacattcaaagggaggacactgcacaatggtgtgaataccaggtggtagggattatgtggggccaccttacagtctatcagccacaacttgaagtatcttctctcctctttgctgccaaataatgtctctgaagactgtaagacctgaatcctatctaaagttgtcggtggttgcttccttcctgaaagcaacaagaagcccatgaatgtcttatggcctgaagatctgccttcaaagactactacctgtgttgtcacaaatggcaagatttcatcctttttatggctgaataatatttcactgtatatgtgaaccacatttttaaaaatgcatttctgaacctgaaggacattatgttaagtcaaataagccagacacagacagacaaagacatatgatctgactaacaatgtggaatctgaaaaaaccaagctcatagaatagaaacagagagtgagaatggtggttgctggggctagggggtcagtgaagtggggaggtgttgatctaagggttcaaacttctcgttaataataaaccagttctggagatctaatgtacagcatgagtggtgatggatgtgttaattaattcgattgtgataatcattacacaatgtatatagtaatcaaatcattactttatagaccctgaatatattcaatatttatttttcaattatatatatatatatatatatatatatatatatatatatatatatatatatatatatatatatatatatatatatatatatatatatatatatatatttaaagctgtcatggaaagccttaaagttaaaatacgaagatttttgagaaaaactttgcatattttaattgctgtctggaatcctccttcagmtggratgagaaatcatctctgggttagttctgtccctgraggtgagggccagacaacacatcaaaactgactttttattttttttcaaagttgttaagactatctaagattcagatctccctaawactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtytgatttcaccccatcctaagatcttgtgactymagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgttgcatagaatgactctcctgtatgaatttttaaaagaaacttcaatatgctatgcatttgaaagggaagaagtaatcaccataatcttgaggtatcttttaaataggcttcctgcgcagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagctatgatgtgkkttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcaggagcatcacttgaggccagaagtttgtgaccagcctgggcactatagtgagaccctgtctctactcacataaaaatattagctgggcatgatggctcataggtgtagtcccagctactcaagaggctaaagggggatatttcttaagcccagaagattcagactgcaatgagctatgattgtgccactgcacttcagcctaggcaacacaacaagaccctgtcccttaaaataaatgctgccttgggtatcttaatcctttctcaagattccttctaaggctaacatttctttgccatccccacactaccatctgctcacttttatatatcttgaccattttatttttcatcccatcttcactccatgtaattagttagctattgctgcagaacaaatcaccccaaaattcagtgattagtttataggtagccccatttcacccatctcattctatagctcaggttgaaagttgagtcatgaattggggaacattcttctcttggtgtaaattagtcaccagtgtctcatagggttgggctgaaacttaacacatcccatcactttgattggctaaagtcagttacataaccaagcccagcttcagaagggaaattgtatgccttacaaggaggtgagaggatggaaaatgaatatttgctgaacagactttytgtccagtttgttgtatttggtggtggtgcagggcaaatatatgtttaaaaccttgttcagatttttagctttcttcagaacagagcttttaaaactgagcatttgtcccctaaattccagcactgcggccatgagtaaagggtgccctgaccacgagcaaatcatttagctggctcacctttcatgcaaccttgaattcaccaggaaggaagttcatgcagccctgggtatgatgccctaattttgagccaagccagctagagttcaagtccaaaccattccacttcctagctttgggacgatgaacaatttacttatgctttctgggctttggttcctaaattatttaaatggggatgattacatacattcatcattttcaccttctcaaagaccttctggacaattccccaattcatagctctgggagacagtgtgttgacactctatttgaccacatcttcctagcagtcttgcggaaggtgccactttgcgaacgatctgttgctaggtaatgtcaatgacatgactttcagtttagcacatgtacagatgaccttgtttgggcttgtgccgttggtaattcagtttcaggatttccgtttgacagaatatattcaagggtggtttcttgctatcagttgtacccttgtggccacagtttttccagataaccaagactcactaatattttcacaagaacatttgtcacctaggtccagatttcagaggaaaaaagtataccgccattgttcttgtataaactttataaaatatttggggaacatcactagccacctgcttccgaaagtacttagatactgtgtcatcttaatacaagacactatgcactaattaagctgttgttgatgcttttttgcctttttgacaattaaaaataatctcataccactggattagtctcttgcctttcaattttatgtttatatacaaatatatgtgcataccaaattttatatatatatatatatatatatatatatattttttttttttttttttttttttggtcggagtctcaccctttcacccaggctggagtgcagtggcgcaatctcggctcactgcaagctccgcctcccgggttcacgccattctcctgcctcagcctcctgagtagctggcactataggcgcccaccaccatgcctggctaattttatgtatttttaatagagacagggtttcaccatgttatcaggatggtctcaatctcctggcctcgtgattcacctgccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgartataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactaygtgtgttttcacttcttctttctttagagaaaacaaatatcatctgccttgctaggtagttgtgagaaatgaggagataatatctttaaatctcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctcccaagttcaagtgattctcctgcctcagcctcttgagtaggtgggactataggtgtgtgccagcatgcccggctagcttttgtatttttagtagagatggggtctcactatgttgcccaggctgacctcaaactcctgcagtacagtattgcaccttcctcggcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgagcaaaagacacagaaaggatttctttatcgtaagcacacttctctacattacctttataatccamcaactytgstattagtaaattatagaamcaacttttgtaacactatcttgtttscagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttratctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgggtttgtcatcctctatttgmaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcagtctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaaagatgtgtgytcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatcaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaaaactgaaacagtaattcccatgtgctgagtttgctgtgaggattaaagacaaggactgttctaagcccggcatataacgggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagttagcttaccagggggtggtgatcttaaaggggcaggaaggagccttgtggtatgctggaaattttccattcatctggtgatgtgatcacttggccgtgtgcacgtgtaaaagttcaagctatatgcttaatatttgtgcacgtcggtgcgtgtaagcaatatctcaaaacatttgagagaatttcccattcattgacagaatttttctcccgcctcggtcaaagcacacagtgggttttcccaacaactgaggtgcctgagggttgggtgccaaagaggcagaaaggccgagatgaccgcttgacctaattccctattcagctgaggcctccacccctggcctgttcaaaggcagttacggatcttttactcaaaacctgaacctaaaaagaaattctttagccatgtccgtgtgaactaaattcagcgtcagatgtacaaggctgtggttctgaccacccccgggctatttctgaccacaggacagcttaaatggtgtggcccataaaatgtaatctgcaaactcaggctgaatgttgatctatttagggccaagagaagaccaggccttggcagcagttctccctgaggtaggatcttaggtcgaatggagaccatcaccctggctgccagccccaggaggctggaaattcgttagcattctttatctttggggatcggccacttacttgtggggttgactcttacagcctttgaccacctcccaaaagctggattcactgatgggcccccaactcaactttcactggccaaagtacttggggttaatttagcaaaccccaggatccccagagggtccctcggtattgtggttttctcctcgcttccaccttatagtggctccaccaggacctcttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggtgggaggattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaracgtgcatgaatctttcaagataagtgtcttattgattaycctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggayactgaggctcagagaaagtgaggtcattgagtcacttgagttcttgttgagtgttctttcctgctgaggtgtcctaggtgcctcttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtcsaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactsaaagaagatgtaactagagaaaaggtactcagtgcagcctctgtgagctaccaccactgcctctagttttccagaaaaccaccmctgaccactctctgtacagatgcgctcaagcgaccataaccaccagtgttcctaacaatgcgcctattgacttcttatttcaatagatatccagattkattatccctcaaggtaagcatcgattttacctttgtctcagtcaatatttacctctgaggtcaatacgtgtggatattcacctcagctgcagtcaatatccatttcgtattacaatatatgatgtgcrtatgtgaaaataaagaacagcatggtacaaaaaaggtctgctaggcaaagaagctttttgcaaagcggatgtgtttttgttttattttttgtttgtttgtttttactgtgtcactttttagaggtcagattctatttcactaaataggacatatgtgtcttctgccaagatgtggaattttggcaaggctagcatgataacaaataaacattcaagcagtcacttaatgatattgaattgaacacmatttctcagaagttcctgtattaaattacaaccataagaacatacacaagcatgcagattgtaagtgtgatgagaatggaaacattccataggacgcagagttattcctcaagcccctggactcgcagagaatcaggtgtatgaagcaagaggaagaagacaagaatcaggaggcaaagagaaggaggaagaagcctcagtggggttgcttctttttatttcttagagccagagctggaagacaaggcctggcatattttggcaggcctggatcagagcctaggtgtgtaaattaggaattgcatttsgctgctgctaacaaggacccaaacatggtggtaaattcttccacataaaacaacagaaaataagttgttttctggccctgggctggggtggccactccaccgtcatcgatgatccgggctccttttctctttctgctttgtgacattgcttctatcttcatgataactcgctgcccagaatgaccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggrgtgtatcctgattcttttgaggawcacttgatcctgattttttttttatgtgtawagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcttgatgggggaatgagcatatatcaaaccaggacagtccaagtccttccggggactttgctgccacagttgacagggggaggtatttgcataacttcaccacacacagctaagctggtgatcctgctgcttggcagcatcttcccagcgtacaacagaggaaaactgcctgttgtagttaaaaaaaaaaagagagagagagagagagactgatacmcaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagaagactgaggaaaggcccccccccccccccrccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacrcttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgyggaaaagggacatggcccagggaaccagagtggtttgggaaagcactttgtcaagaggctkggggaccccagggtggaagytgccatgcgcatgaggytgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagatamttagcatagccrtcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgttgtttctgctcattttttatattcaaaatttctaatcatgtgtgactatatatgtattatacatggtaggacttatttttttaatgtgaaagaatataaaacaaaatacgatattatcttttgagtgatatcaacaaaacaaaacatgatatccaaagtcaccctgtatggttggatactttgggtttgccatcttttcttttgttcatttgtttcatgcaatagaaacgttttgagatcctgtctggctgggttctgctaggcctgggtctacagcagtttgctgtcaaggtcttggcccttcaagagcatgtagtgtggtggggaaggtgtacatcagtgaagaggtaatccaggtcacggtgggatgacacaggctgctgtggcaacccacagcaggaatagccagtcctgccccagcagggcgtatcaggggtgctaaggtgacttccaagattgaggttggcgagwtcgtgacaggtgtgcaagatggggtgttccaagactggggacaggacaggtgtgcaaggaccagccagctgaggtagaggaaacctagacctatggaacatgctgatttcaaggtccatttgtggggagaacacggactgtgtcattggaagccagcagggagaatcagttgagaggtaagccgggcctagtagaaagtaagcgaagccctttcattaagtgaacgaagggtgcatggtgagtacacagccatgaaaataaaatgatataaatcagcacggtttcagctgccctcccatctttctactgtgatctcagcagtgatggggctggctttgagggttggagatcacacacacacaatcagccagctctccaaagcaagccccacactctcttgatgctatcctcaataaacatgcggtctaaacagtaaccatgttctagctatgcagatgcagtttaaagacaaatcctttgagcctccagcatgcgatcccctcccaatctcattgctgctcccctaccctcttctgcgtagaagcgctggagccaggtgcttacgacctgggtgctagtatctttgtgaaaactgctcctgacctattgctttgtttattttagccggtgcctttgtagagggaaaacagcttagcaagcatttagtaggtagatccaaagtccccaggagctgttgggaagtccataggtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtrtatatatatatatataaaatatatttccatgaatatactgaatgctaagccctccccactttttttttcttttttaaattcagaaatttctagttgtgtttattcccctcgtcagcatactttatcatatcaragccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcaaacgttttgaaaagaaatctcctttcaaaaatcacagcactggttgaagcaggagcatctctcccyttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcccaagkctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatccgatctcgtgagacttgttcactatsacgagtaaagcacaggaaagacttgccctcatgattcagttacgttccaccggggccctcccacaacacatgggaattgtgggagcgacagttcaagatgagatttggrtagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatctccattttaagtattcttttctttccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggaytcagatgtcactgtgcaggtgactcacgcctagaatcctctgcctatcgtgacagggagaagcctgtgtgaccctgtggccatctcagtctctgcagggcatctgtagctttggaggtacctgggcaagagactgcctttcctactagagcttctgccatccctctgtcactatttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgyaaacwctgaattctataaactgttggagacagrttctggagagacactcaggcttagctctagaaagaaacgggtaagacagaggaggttcagggcaactgtgttgccttccttgactggtgcatgggaattccccagcagagagaaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcrgaagagtagggaaaggtgacattccaactgggaatattmgactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctggatagattttttttagacagagtctcgatctgacagccagactggagtgcagtggtgtaatctcggcttactgcaaccttcacctcctaggttccagcgattctcctgcctcagcctcctgagtagctgggactaaaggcacgtgccaccactcctggctaattttttatatttttagtggagacggggtttcactatattggccaggctgatctcgaactcctgcccttgtgatccacccacctcggcctctcaaagtgctgggattacaggtgctagccaccacacccggcctcttctcgatagatcttatttggctgacaacgaaagctgttgtgctggtagcatcatccctttgcatgcaaaagataaactgaaatctraagtagccatatccttccggccaggtttttcaagtggttactctgttctgatcattgtcatgacaggaatagtgaaaataacaataaatcatttttctttaacgatccatttactgtatgctgggcactgcacaaaatggtttacatggtttatcttgtagcgttccatttaagtctgctaagagtagatgctatcattctctccattttacagataagaaaattgaggcttagagaaattgagtaatttttgccaatcctgagacttgaatctccgctctgtcttctgcatacactttttacttgtcattgctgattagctttctctttccatctccctgatcagaaccattctgcgttcttagattcaacaaaatgtaatactccaccttgccagtatctagcgtgttttcagaaattgtgaacggggtggaggtggagtactaactgcaatcagatgttttatttgtttatttatttttccttcttgcgttgctcttaagcccccactcttgggcaaggctctgtgctatgctgttttatgcacatcatcttctaacagcttctctgccacacctggagaagtgccaatatcattttcatggcacagataaggcattggatgctcatagtttaagtcatcaggtggtgactggaggagccagaaggtccctttgggcctgtcctctcaccagcatcaactgcaccaaaaagatctcattctgattatcagggatgaacccccccactgggtgatcaggcaaactacatgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacctgtagtcccagctactcaggagactgaggcaggagaatcgcttgaacccaggaggaggaggttgcagtgaactaagattgtgccactgcactccaacctgggcaacagagtgagacactctcaaaataagtaaataaatataaaataaaataaaaaatatgtcctgtaatgaaattgaaagagaacactttgtttcttatctagttggaacaagtggggtggggacagacaagtgactgaccactctccatctgactcagtgtcagtagactctctcaaaaattagaagctggctgacatagtggctcacacctgtaatcccagcacttcaggaggctgacgtgggaggattgcttgagcctaggagttcaagatcagcctgggtaacatagggaaacccttctactacaagacatagaagaaaattagttggccatggtggcacacacctatagtcccagctactaaggaggctgaggcggtaggatcgcttgatcccgggaggtggaggctgcagtgagctgtgatcacgccactgaattctagcctgggtgaccgagaccttgtctaaaaaataaataaataaataaaattagaatctgaattttgaagacacaaattcagatgcatgtggatgggcccaaaatactttgtttacatgtactccaaatgtaactcctggggcacccttccttattttctctaccacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctccctccttcccttcccccctccctccttcccttcctccctccctccttcccttcctccctccctccctccctgtcttcttccctccctccctcccttctttccttcctttctttccttcctccctccctcactccctccttccctttttccctccctctctcccttcctcccttcttttctttcctttttaaatgctgattttgttttctttttaaagccctcagttggcaaacttaaaagttgttaagtctgtgttagcctggctagctttttttttctctactagaccttcaaagtctaggaatgcctgatgtatctgtatcctgtgagtttgccacttcatgatatttgatatgtcattgtttccccataattttttcattgttagcgttgtctctccagcctcctgcttcctcttcctctgtctccctcatggtgtgtcttgctcaggcatgtcttatataatcaatatttagtgatttgacttcttaagtccttaaaaaaaaaaaaatccaggtgcaaaacacaaagacagggctcatgtcaagggagggaacctcgctcttctactctcagtgaaagaaaggcaagaccactccagcctattttttttttctttcccttggcccttgtcaaaagggtagccagttttctgttaccattgtgctaactgaagaatggaaaatatgcccagagtttaaaaaaaatcaaccaatgcctgccctttctagagcaacctaattaacaacccaaatgttaaaatttctttatttagaaactcagctatccagaattacaactccgcctctcgtgcttggaggcatagttctttgtcatattcctgagtgtctacagatgatgaaaatagccagttatctttgcccttcatggaaaggataggaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcasatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaagaaagaaaaaaaaaagggtgcttgatgccctgctcctgctatgtccgggaatttcttgtacccttcatatgagcccctctgaacaaaagcaaatcctgttgacctgtcagcttaaaaagacaagaaatatgccacattccgcaggaataaggagaaaagaatggtgcgaaaatcagtgacacgaagttgaatatgtgaacacatccagacaaatgtgaagccagcccgattaggacgactgaaagggcatttccccagaattgcagttttttttttttttttttttttttaaataggggacgctattgtcattcagaaagccacaggctgttctgaaaacaggcaaaaatcaatagcccacttgttgaggataagtgaattagcctgtgttgaatgtaactgagtacctgaacacttgagtgggcagggattgttggggagaaaagacaattgtcttttatgtccacagcggttcacatcgctgattaattatgtccaatgatcatttttgtgcaggactaatgggcagactctgtttttgtttttgtctgtctgcccacaacctggtgaactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttctttttttttttttttttggctgtctacagagaaggaggatataggggcccttaagagaaaaactggagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcrggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgggagatggaaccattttagtgcatttgatatgatgtgatgtggctttctccaagcctgagagtgcctgaaacccagagaggtcgtacgttgaccatgccacggggcccttcctggtaaatctaagcagaaatacaccatgcatgagacagaacaaagaaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttktttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagccatctgctaatccctgtgatttaaaaatgtgcgtgtttttagtttctgtctaatttcaaccttttcttgctttagtgattaattaccaggtttctctattaagagcttgtgcgtgtgtagggggtagcatagaataaacaggctcagagcccccacccccacccccctttaagtaacagtgacgcaaacgacctttatttagcagaaggtagctctgcgaatccgctgaatgtccgattgcgatctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacagaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgttcatcatttaattagagatttgcttattgaaacgactgaaataggtagttgaaattttgcccttggacaagggagtaatttgtgatttgctacgttcatttcgtgagacttttggtgaaagacatctccttctcatatgtttaggcaagcgttgatgacatcaacctagccttttattttaaatcccctgtcaacgcaattagataatacaaaaataacaaaactataggaggttgaggatggggctgggggccaaggagattacttggtttgaaatgaataaattgtctatcgtaagggaattctttggtgcattttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgctgcgttagccagcctctgcatgattttttacgcaraacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtraaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtaggactacagttgtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaamatgagtgctcaagaaatagtaaattttartatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctccactggttcaacacacctgaattccggattcaagatgcaatcaccactactgttgttgtgtaagtattgctagagatggctgcagaatacctgggaaagctagctaagcagtgactggaggaaggccccagctctttggaacgaactttccagccgagaatgctttccaaaatgggaacaagatcccaaccccttatcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgcctttttgatactaacgctacatgaagagggacggggccaacagcaggctcttccttgacgtgttttatgtacactccagaaatattgacagagttgtctttttgttttggtttttaaatgtttttttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaactctctgttttttgaaaggkcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgargcggagtctcactctgttgcccaggctggagtgcagtggcacagtctcsgctcactgtaagctccgcctcccgagttcacgccattctcctgcctcagcctcccgagtagttgggactacaggcgcccgccaccacactcagctaattttttgtatttttagtagagacagggtttcactgtgttagccaggatggtctcgatctcctgacctcgtgatctgcctgccttggcctcccaaagtgctgggattacaggcgtgaactactgtgcctggccaggataatctttaagaagaagataacattagctattcttctcacttcctacgtagaattccmtaccctgtgtctttggcctggaaagggtattggtagcaattgtcttcggctttccctgccatgtgtatgcattcccacggccacacaagcacacacacacttttgtggttttttttttaattatataagcaagtaggatgtttgtcttagtttttttgggctgctataacaaaatgccatggactgaataatatataaacaacggaaatgtatttctcacaattccggaggctgagaagtccaagaggaaggcactggcagattcagtgtccggtgaggatttgtttttgatctcataggtgtccatcttgctattttctcaactagcagaggcaactctctggggtatcttttaaaagggcactaatggccaggmgtggtggctcacacctgtaatcccagcactttgggaggccgaggcaggtgtctcggtggatcacttgaggtcaggaggtcgagaccagcctggctgacatggtgaaaccctgtctctactaaaactaaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctmatgacataattacctcccaaagtccgcacttcctaatgttaccactctggaggttagaatttcaacatataaattttggggggasacattcagaycacaataatgttttataatgttcmttttgctttaacaagagacacatgtcagatagtagacatgatctgagaagacacaaaacccagcgtggtgattttggcagccttgccatgcatctctaacatgcacrtggccagaaaaatagcttggacattctgttcaaccctccacatsaactggtcagtttagtctttaaaaggtgataggcctgttgtsgtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatsactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttcttccttgtaatatgtataatgactcatgagagaattcyccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattccagcactttgggaggctgaggtgggaggatcactggaggtcgggaatttgaaaccagcctggccaacgtggcaaaaccccatttctactaaaaaaaaaatatatatatatatatatatatatatatatatatatatatatatatatatatatatatatatatatatatatgtagccatgcatgggggcctgcccttgtagtcccagctacttgggaggctgagacatgagaatcgcttgaacctgggagtcggaggttgcagtaagctgagatcgccactgcactccagcctgggcaacagtagcaagacgccatctcaaaaaaaaaaaaaaaaaagtgtaatgcaagtagaaaagggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtaaaaagaaccatgtgaactgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaaccaagtgaaagagaaaatgagactaatctctaacctcagcttccttttctgccaaatggaagatcatctctaattaataatgagttagaatacctaggacagtatttggcacacagttgatgaggatggtgtacctagtagctaatggtgagtaggatgaataataatactataccttttggtttctgaaatgagaaatctaaggaactggcttaaccaagaagcagcaagctgttttaattgtgctgttaggagggctgtttgttaaggtacagaagaggattggcccatggctttctgctaagaacctgctgaatgtctgtatagaatccctgcattgtgcctcctatcaatcaggtgcttaggtttgacaagtttcctccaacagactcgtgtagaagtttctgtatcaactggaaaaaaccatggtgcttgggacattcaaggccgaaacttggtccctggatgggagaagatagctgtatcattggcagaggtgccttggtcatgtaccctctccagactagacactagatagtgggtagggtgggacagttttatgtcctctgccaccttatctgggactcttgtcccctgagaagtttgaaaatttggcacattttagtatttgtcagtgtacttcctgcttcttgatgcacttgtactgcacaagaattgattttcaggaaatatggtttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcatttacccagattgtgtttctggagattaaagcatctcactgtatttttatttttttctacattgcaatttcaaaataatccaactcaaaggctgttgaaaggctccttctgtttaaggtaaagcctgtggcagcctttaacttcctttctcttctcctgctgccaccttggtccacaatttatctttgaaaatgctgggttttaatgggcagggtatagtgcagaaaccagatggttttaactcacacctgtgaaaatgctggggatctgcgaaacattaaagttaatggccagaataaggctgccaagctcggtggaattgtacttaactggcatatcattctggttaactgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattggccagtatattcaatgattcacttgcacctttaaccttgtgttgttctaatctttttttttttttttttttttttttttttttttgagacagagtcttgctctgttgtctaggctggagtgcagtggcaccatctcggctcaccacgagctctgcgtcgtgggttcatgccattctcctgcctcagcctgcggagtagctgggactacaggcactcaccaccatgcctggctaattttttgtattttttagtaaagatggggtttcaccatgttagccaggatggtctcgatctcctgacctcatgatctgcctaccttagcctcccaaagtgctgggattacaggcgtgagccaccgtgcccagccttcttgttttaatcttttagacaactggacacaggtttgtctttgaaattgtcctggtttttcttgatgttttagtgctcctggatgtccaatgtcattcttgggctagttgaargaaagttttggctacccagttgttagctgctgaagtttaactgtgcattctaagcacaccagtattttattacatcatacctgggcagcagatarttttagtaaaaccttgaaaagatatgactattgggaagaaatttgggattctatcctttttctctccattcttctctcctgcaccaagtttctaagctcgtgattaaataaattctgaccctactctgataaaagtgaacccttgtggctggtcgcagtggctcatgcttgtaatcccagcactttgggacgccgaggcaggcagatcacctgaggtcaggagtttgagaccagcctggccaacatggtaaaaccccacctctactaaaaatacaaaattagtcaggcgtggtagtgtacacccataatcccaggtacacaggaggctgagacataagaatcgcttgaacccaggagacgggggttgcagggagctgagatcgtgccactgtactccagcctgggtgacaagagtgaaactccatcttaaaaaaaaaaaaagtgaacccttgtagtttcttcctctgtttgacagayggaccctaagacggccccagtgataccccacctcctggtgtccaaggcctgatgtgatcacccttcccccaccttgaatgtaggtgggacatgggacttacttctgaccaatagaatatgaaaaagataataggatgtaactgtttagattcggttacactatatggcaaagcaaagggattttggaaataccattaaggtcttacatgagacagattttgagttaatgagcagggggatcctcctgggtgggcctgacttagtaaggggaaaatcccttaaagaggagctaaaataagagagtctctctctccattgctggctttgaaaaagtaagctgccttgcagtaaggaactgcatttggcttctaggagctgagagtgccctaaggaagccagcaagaaaatgaggacattagtcctataaccacaaggaaatgagttctgctagcaacctaagggagcttgaaggtgattgaccatccccagtcaagcctctgatgagaccgcagccccactaggcaactagatttcagcatggtaagaccctggatggagaacccagctcagccatgcccagactcctatcctatggaagctttaagataataaatgtatgtggctttaagctgttaagcttttggtaatttgttagatggcaacagaaaatgtgtacaccctggatagtagacagagactgcatctttctttggcatttggctgcacagcaagttctaagttactcaccaggtttcagaggagagatgggaatttgatgatcttataagaaacctgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggactkcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaaaagtaaatgtgttttttgctattaaaagtaatgcggttttacttctgcagtttttttgccatttgccaattacttttgcagtttttgccagtacttaaaagtaatggcaaaaactgcaaaagtaattggcaaatggcaattgcggtttttgccgttacttaaaattgcattacttaaaagtttttaagtaatgcaattacttaaaacttaagtttttaagtaagtttaagtaaaatttgcattacttaaaagtaatcgcagtttttgccattacttaaaagtaatggcaccaacctaatattgttattactttttaccaacctaatattgttattaactaaagtccatcgtttatcatattgccttaggtttttaaaaaattttttacctaatgacttttttgtgttccaggagcccatccaggataccacttttatttattttttttttctttttgagatggagtctggctcttttgcccaggatggagtgcagtggcgcgatcttggctcactgcaacctccgcctcgcaggtttaagtgattctcctgcctcagcctcctgagcaggtgggaccacaggcatgcgccaccacgctcagctaatttttgcaggataccacattttatttaattgtcaggtctccttagcatcttcttggctgtgacagtttctcagaattgtctttgtgatgaccttgacagctttgaggagtgctggttgggtattctgtaggatgcycctgtgttgggatttttatgatgtttttctcatgagtttactggagttaatgaatttcagggaggaagaccccagaggtctgttttcatcacatcgtatcaagcattccaccttcatcatgactcttcactgttgatggtgactctgattcacctggtcaaggtagtgttcrttaggtttctccactgcacacttagtctttccctctactttccacactgctgcctttggaggagtgttgctgtgcccagctcaygcttgtggagtggggatttaatgttctcactcttcgagggtagagtatctgcataaactacttggaattctacatggaatatttgtgtcttctcccccatttatttatttaatcatttatttatatcacggtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacytgattggccamctagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctrtgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgatgcaaatcctgggaagactctggaacaacatggaggcacctatgttaactctatttcattttggaaaagttgastagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttsagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtattttwwtttttttttcctctgcaagggatggggtcataagacattggtgaggttaggccttcctttgtctcccaggagcacacttgatagcaatgtagggtgaattccaaatctgtgagttagtgccatatatagcagtgttgtcagtaagatttctcactggcatctctgcttcccctcttgactctcttgaaatcccttcttcaggcagaagttggagtcatttctctaaaatagaaatctgatcttgccaccaccctacttgccactccctgcttaatcccttcactggctcaccatatcccttaggataaaataacaaaatcctttccagggcctgcaagacccctgccaacctctgcagcttactttgtaccactttccccagaaacctgctacctaccctgctccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactggstgaatgaacgaaagasgccataygcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattctgagattatgttcaacagatattttcagtgttaaaatattcttttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgattkaaattattctgkcttctatgaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggccawttttttttttttttttttttttttttggkggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgatcgcctctccacccctgctacgtgtaatagaaaggtagggccatgttggagagggatccaacatttattatccccattttacagatgaagaasttaaggtggccaggcatggtggctcatgcctgtaatcctagcacttygggacactgaggtgggtggatcacttgaggtcaggagtttgagagcaatctggccaacatggtgaaaccctgtctctactacaaataaaaaattagccgggtgtggtggcgtgtgcctgtaatcccagttactcsggaggctgaggcaggagaatcgcttgagcctgggaggcagaggttgcagtgagctgagatcgygccactgcgctccatgctaggtgacagagcaagattccatctcaaaacaaaacaaaacaaaaaaacaagaagttaaggattgcagagcataagtatcttctatggggctacccaactaggtcgggacagggcagggatttgaacctaggagctcttggattgcaatttttcattcacccctccctctccacccttcctgtcttcaagcctgagcaggtgatactgcattttgtaccgtatgactttwaaacagaaccacgagttcagaactttggttaggtcctgcccgtgttctctagctaacgcatggcaacgctggtttccaacctttcactgtgcgggtttctgatgagtacgctggcaggcctctggcttcagagatgccactacaaaggtctcctccttttcataaacattgctgcaaggcccgcttctcaagaaagcaacttgtgctacctcctgcgtgcttttatgcttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgktttccttcccactcacatgtaggtcacctacgggagcargggaggaaccatctgaggtgtttttttttttttttttagatttctcattgctgagaacagttccagctctgcygaccaaaggctgagtgtccytttattagtctgagcccctagagaraccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttcaaagttstagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttwaaaaaaaaaaaaaaaaaagttctaaatcagtggattctgccgataaacatcatctggacggaatgaagctgagggccaatagtttagaggctcagcacccgactggagagagagagagagagagagagagagwgwgwatgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggarggcagacaagttgctcatcctctctgcgcctcagtttcttcatctacaaaatgaagatgttggttatttctttattcaagggttgttgaraggatgaagtgctaaaaatgcttgaccagcattcacacaggcactaagacggtgagtactcactacttakcgctgtcaacatcatctccgtccacatcaatgtcgtcatcgtccttatgaaaagccckgggcatcattttgcccttgagctggatgtccatgttggaaaaacagctagtgraaggcgtgcccaaatctcagaagttggcgtttccttgcagatatcattggtggccattggaggggaaaaagatgctttggaaaccaggacacagagaaaagtgcctcgtattatacagagccaagagaggtcactgtggaagtacagaggaagccttggcctaattgcacggttaatacaattccgtaactcatcctgccaacacgaaggtagatggacggtccttatgctcgctgcggaacactgcctgtgttttcctaggagagacatctgcactctagtagtgattaaaatgcctttgacaggctcttgctattaagagtttctggctccagtttaataaaaggtagtatattataatggaaaccaggttattattgataaggactagacatattagagaccaggttaaagctttgatagtcccaaatgcaaggggagggagctaagggttattgcaaacctactgtgtgtcaattgctctaccagacacctcagagacatcacagccaaagacccccacctttgaataaaccaagtttggcctctctgatatattaatatatttaatcatcagactttcagtgttaaaggagattacagtagaggcatccagttgattggggaatagttgttgcaaatgataagctcttttgaataaactgatactgacttaatgaggttctgctgtgtactatcttttttttcctaatagaaaatagagtagctgccctccccatccgccattctcagtccttttgcttactagtaatgaccctcttttctctcactccatgggaacttttaaaactgataattaatggatttttagcctcaagtttctggaattctaagagggcctgaaaggtaagtgctcacttactgaggtgtgtgaacaaaaacaggcaacctagctcagcaagtaagaatggagtggcatctccccacctgctctggagtcatgtgtttgcttctggaagggaggcaagaggcattcaacctcctgttaatttggttgctccttcagatacgctcttcatggtacagccctgasctgcatcatttaaagaccaattgttaaggaccaatctgagggcctgtgcattagttaaaactccttatctggtcatagagggtggtgtggtttggacgcgttccccttgtctgtgcaattcccaacagaggcaagtgcgcatttgagacaggttgagggttcaagctgtccaatccctgctcatctgcagcacaccaaggaatgtggactaatgaaaaataaactgcatgcatgcartgcccatcacactgcctgcattttctaatcttcacaataactctgtgttgagaaatattcctgtctgtaatcccggcactttgggaggctgaagcgggcagatcacctgaggtcaggagtttgagaccagcctggscaacatggtgaactccccccaaccaacgacccttcccatatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccagsccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccaggagtctgtgtttgttctttaaacctctctattcagttgcccagctcttttcattccctgtcctttccccctctggctgggtctgcctttccaaccgctaccaccttccaccaccattttttttttgttkcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagattccamtcgaatacattagagcattagagcttttctcttcctcagggtgctctctctctctgggttgggaggagatgtggcatttctaggaattcacagtaaaatcagaaataattaggagatttcacagttgtagctcctgtgaagattcaggaattttttttttcttctatttgcaagctttagtcctaggcatggaaaaagaactttgaagaaaacctgagagatatsagtgtaaaacaagagaatgattccctctggggtgctggtagtgggggcttaatttcctaaaggcttactgggtatcagggctgctttcctttataatcttttacccgtcttatgggggatgaacagaaacacactttagtgctagaaaagctgggccyaaaagaccagtctcctgtcccatacttggacatttattgttctttttgggcaaggtgaaaacttgaaaccaaaagtctgttgagtttggaagacttgactcccaggatgtacaaagtacttctgcatgtgcgcaaagtcctgtaggcccaggcatcaatgacacatgcagtgtgggcccaggcatcgatgacacacgcagggaagcaacccaagctgggtcagtccttacaaggagaccggcacctgggctcacaccttgccgtatatgacttcatgggaacctcataacagacctgtgggctcagaattattctctcactttgcagatgaggaaatggaagtgcacagaaggaaagtaagagtgtttgagatcctgtagtgggttcattgctgagaataaacccggagttgcctctgggaggacctggtggtgggtgggatggagagagaggcctcccctcagactccaggggcacagattggattttttttttttccagacagagtttcactcttgttgcacaggctggggtgcaatggtatgatcttggctcactgcaacctctgcctcccaggttcgagtgattttcctgcctcagcctctggagtagctgggattacaggtgcccgccaccacgcccagctaattttttgtcttttttagtagagacagggtttcaccatgttggccaggctggtcttgaactcctgacctcaggtgatccacctgccccagcctcccacagtgttgggatcacaggtgtgagccaccatgctaggcccagattggcttctgtgtgaggatgaagagtaataggaagatagagtggtgatctaatgtcaactgtggagggagtgggaggcaggtgttcgcagggcacagctggtttcctttttgaatcccacccagtgctgggggcaagtttcataagcctgtgaccacccagataggaaagtacacagcaacaccaggcagattcattttctttaaatgaggggttcaaaatagaaacacaaagcattgagtattgagaagaaatggatcttcaggtttggagggaggccgatagagagtgtctggagttgccaacgtcctctccttgggtcatgggtgtgtgtgtgtgtgttttcttcttgktgktgggtttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcaraattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaaraaagaaggggccgggcatggtggctcacgcctgtaatcctaacattttgggaggtcgaggcaggcarattgcytgagctcaggagttgaataccagcctgggcaacacggtgaaaccccgactctactaaaatacaaaaaattagccgggcgtggcagtgtgtgcctgtaatcccagctattcgggagggtgaggcaggggaattgcttgaacctgggaagcagaggttgcagtgagccgagatcatgccactgcactccagtctgggtgacagcgcgagattctgtcttcaaaaaaaaaaaaaaagaagaagaaaagaaaggaaggacagatggaaggaaggaaaagggaagggaaaggaaaggaaccagctgcaaaaattgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctargtttatgtatggattaacacagtgatagaccctgagtagcaaaagacgaagactaattacctgacagarctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagtccttggaaaatgcaaagagggggaaaaagaagaaaaacagcaacgarkttattggagagttaamacttaaakactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagggcttctgtctccagattccttgttctgtccctttatgctgactttccttttttgctcaaagtctctctccttgcttctttctctttgggctccctgcttttatttcggccctgatggaatctgtcgactttactgagctccatgtatgtgcaccaggtcagattcaatgctgcctaggtccacagtcctcagttatttgttcctgtgattttcgcgccaccaggagccacttgttggatgagatttccgggcaagttgagtctccatgtttttgtcgtgggctactgccagctgagatatggatgaagactccctttcatgtttcccttctttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgwgtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttgaacctgggaggtggaggttgtggtragctgagatcacgccattgcactccagcctgggcaacgagcgaaactctgtctcaaaaatgaatgaatgaatgaatgaatgaatgaaatactacttctccctgtcctccccaccctaagcatctgatcagacaggtagtgctggtggacagatggacagacacctaccccatatgtcacctccctcctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacaytagtaggtacagcaggagagcatgtagaagaggatagatgtagaaaatcgggacggcatgttaggaatatagataggaattactaaggaaaattgtatttttgtggaattctttgaactcgttactattagtaaacggtgagttttggttctactcttcaatgagtttaagatgaaggaaatcattaaatagtgctttcttttcttcaaaagttgggttgcattgcatagttaaagttctttaaattcttctctaaaccccaaggctaagcaatatacaatctagttacaatggtctgcttgctgttaccagaatctrtcaagctctttcctatctaagggttttttccatgtactggtttctctcctgcgtggtcttgttctacccttgaggagggtaccacttcctcattgcttagttgtcagtataaatgctcctttctcagagaggcccatcctgaccatctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagmctttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatytcccatcagccgaaactaactctgctrtgtcrcgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccartgccccaatctggartccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacayggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaraatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggtyccctttgtttatttttacactagctttgcactaggttaattttttcccacatggcttttcctgtttgtttctttgattgtttttaattaataattagtttgcttatttatttgtttattttttgagagggagtctcgctctgtcacccaggctggagtgcagcagtgtgatcttggctcactgcaaactccacctcccaggttcaagggattctcctgcctcagtctcccaagtagctgagattacaggcscccaccaccaagcccagctaatttttttggttttttttgtattttagtagagacgggatttcaccatgttggccaggctggtctcaaactctggacctcaaatgatccaaccgcctcggacttccaaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgttgcccaggctggtgttgaactcctggcctcaagcratcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacktactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccrtgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctgcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgkaatgtgattctccttaacagagggattcgtaagcttargamtgataragawttggcttttctgctgttggattgatagctccttgactgctgaagccattgcccatctgttcaactgktgkattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgygagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctsggtgacagagcgagactccgtctcaaaaaaaaaaaraaararaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcayataagtaaattatatgattggayccaggcataaaacgtgatttgactcccccttgcccatcacagttctggagttcacatatcatttgttactttgaaaaatgaacttttgttatttgattatggtgataaataatatacatggtagaaggagaagaaaatgaagaaaaatttagaaacttggacagaggaaaatgaaaatgttctattaattccactagcatgagataatcactcttaatattttgktgcatgttcttttctttcttctgarkgatagcatttttttcaacaaattgggctcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcrggcttatttwactatttatttttgccttacactttttgtamaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagamcttctgcttcctctggacactggcgcagcctggactagcagttgscagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctacttaaagcaaaatgccttctcctaaatccaggtagagagaaactctcaaaggccagggtctggactcaagatgagcacaggatttagaatcagaaagtgtgagttcaaattgccttcggctcttcacctgggtgggcgatttgaatagagctcacagccctgaaaaccctggttttcagaytctttattggtaaatgaagtcagcttagtgatatgagaattatgaaacataaatccctttgtaaaaatataaaataatcttacaatcatcatcgtcatcctcatcatcgtgttccttcacaccagcggtatttatggtatttatcaactaactgctgtgtactatgctctattgaaaatgttagcaatatagtaatgaacaaaacagatgttatctctacccttatggtttttatattttaataaaagtggcagaaaagaaataggtaaaacaataaactgagctctttggagaagaggcccacgttcttttcagattctgatttctccgtgatataaatagttttttaggtgatcacttgtttttaatgtacctacctatctawacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatastctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagaaaaacacaacattgagtgaggtctagggtgaatgccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagawcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcstaaggaaacttaaaatcatggcagaagatgaaagggaarcaggcatgttctgcatggctggagtaggaggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcarttgcrcaattcacacaccaggctgccactttggcccctgcgtcaccttcaccaccacccaatgtgtcctgctcatcactgaggtttgtcatttttactytgagwctgtccattgtcatcatctccaccatcaccccttttgttytcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtggacaagaggtcacattgccttttctagcttggaaggtggcgcaaataactgcttgaggctccctctcttgggccaagcttgactctggattttcattgktgtccttttttattaaaacaggttttgkttttttgtgtgtgtgttattttgttttttgtttttttgtttttcgggggctggagtagtgtgcaragcctggcggtgattgttctcattaraaagtatagtgtaatactcaataaattacttttgttctcaccttgggaagtggactmagaggccaagtgactttgatttttcactttatcctggagtttctcaaccttggcactattgacattttargccaggagattcttkgttgggggggatttcctgtgagttacaagacattaagcaacatcactggcctctacccactagatgccagtagcatcttctatttcctcaagtctcaaaataccaaaaacatttgtagatactgccagatacccctggggaacaaaatcacccctggatgagaacccctgctttatcctcttacagttttggttctttccatgagaaagtatttttaatagcaaagtaatgaacaagaaagtattaataagacccaaataataatataaactactmctttactaatggtcattatgtgccatgccctgctctaaacacttgccatgtagtcactaatttaatcctcacaagaattctgtaatgtagtgtagtttcccagggcttccttgaaaacgtgccatagactagatagcttgaaacaacagagatttattctctcacagttttggaggccagacacctgacatcgaggtgttggcagagttggttcctcccggggctctcagtgaaagcctgctccgtgcctctcctccagcctctggtggctgccattaatccttgacattcgtcggcttgtggcagcagaaccccagtctccgcctccgccttcacatggccatcttcactctctgtctttgctcccttttcctatagggactcaagtcattggatttagggctcactggaatccaggatgacctcattttaccttaacaagttgcatctgtgaagattccatttctaaataagatcacatgctagggctgggcacggtggctcatgcctgtaatcccagaattttgggaggccgaggcaggcggatcacttgaggtcaggagtttgagaccagcctggccaaaatggcaaaaccccttctctattaaaaatacaaaaattagccaggtatggtggtgcgtgcctgtagtcctagctacttgggaggctgaggcagaagaatcccttgaacctgggaggcagaggttgcagtgagccgagattgtgccactgcactccagcctgggcaatagagtgagaatccgtctcaaaaaaaaacaaacaaacaaacaaaaaaaaaacaaaacacatgctggtgcacacataaatttggaagaaatgctctttaacccagtatgagcacgtggtattcttatcctcattttacagatgaggaaattgaggcacagacagattcaataactacgtgactcacagagataaccgtgtagcagaatcaggaattcagcccagttttttcagttgcacagcctgagctcctaaccatcgcgcctggggttctcaaaggctcgtccccaagcgacaacatcagggtcatctgggaacttgttagatgtgctcaccctcaggctcgccccaccccgccagacttcctgaaccagaaactctgggagtagggctcagcaatctagttttagccctccaggggattctgtggtgcctaaagtttgagaacttctgatcaaaaatgccagataagaaaaaaaaacctttcgagacatcatttgaatcaattatcaaatgtttccaaagtgcrcttgctttgcaaaccactgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcrgaagagcaaagtccgggtccccaggctcaactatcagccgccttctcatcccaasggctgtcaccaccagaaatttaacatgctgttagtgcatgcaaaaaaaagcccagtaattgtagsgctcatcagtacattgttaattgatcctcatttcctattattttacctcaaagcmaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtacactaaaggtccctcttccctggcagacagtggttcattttatttgaggaggtatgttgtgggcttggggaaacagaaggaaattggagacattgatatgcttcctgagaggtggaaggggccacttaacacagctttcatttttcagttgccartgggagaggagctggggtgggcatataatgagtaacattcaaagctccttctgtctttttttcagagaattcacaaaacaactcagggcctcctggtcctgcaaaagtgtttactgtttatttgtgttgtttctgcttgttttgcttgccaccagctccctactcacttgggggaaaataacccatcaaaggaatagaagctcaggataaacgtttcagacctttcagtaagatagtaaaatttctttcattcccagacctctctccaaaagaggcagccatcattaaaagtttgttatggattcttccagaaacgttctatgcatttagcatcagttgcagatatggatagccttttcaaaaaatgcatgcaactgagactattggctatgttttgtttattacctactttttccatttaatagtatcttggagattatttggtaccagcacatgtagctcaacctcctaatactgcatgacggataatatgccatcacatggtgtcatttaatatattcattcctatttatagacattgaagttagatccatgtcttactatyacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctwccattcacacgtgagaatgcctgtggccccccagaaattatctccagcagcagcaacagagaggactggaatgccattgacaggtcccacaagtcagcaatcagcacgccattttttaaaattwatgttgctattgtatcgtaaggttcttctgaagcgaccacttcataacactgtgtagtccaatccctaagctgggcaatttttttttcccctttcaawacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgaraggtggggarggggtgggggctctgtgcatggaatggggggaaaagcttcagggaagggcagtgcaaattgtttctggactgatgccatctyytaataatagtagttaatagactgggtacaatggctgacgcccgtaatcccagygctttgagaggccgaggccggtgtatcgcctgagtccaggagttagagaccagcctgggcaaacagcctgargcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtastagtgaatgccctgactttggggtttgcagtaagctaggattaagtgcttcacagtgaggcacagtggggagctactctgaggatgaawtgcctartaaataarkgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgyaatgagacatctagtttttttctctttcgtttgttctgtttcccactgagagaattttctagctttatgtggagaaaacagtattggaaattattactcagttcaagaaaacctcactgagcacctaccatgtaggtgctcatcccgataccactatcaggmcctttggaccagttgcaaggatgcaggatgaggaaggcaatgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtggtcattgactggggctggattcgggaaggatccacttccaagctgcacagttgttggcaagatgtagtgttttggtggttcctgggctctgggactcagctttttggctgttggttgttggctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctgatttctattatgagtaatgctgctatgaacattcatatacaagttttagggcagacttctattttcattccaatatctctttatggcatgtcttagcagtgatgtctatgacatccaggatgtgtcttgacatgtctgacatcatttaaataaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacarggataatagacaacgctatcaagarggggsccaaccacacatgtgcagccactgtatgacgtctggattttccttgasttatggtgatcactattgggaggtggtaagcaaacaggtgacataatttgaatcatggktttaaaagacgccatggttgccatgaggaggacaatgcgtaggaggcaggagtgaaagctaaaggatatgctgggaggtgaccctggagttaaagaragcaactaaggtgaccaggtgacaataatggagatagagaaaacaggatggattcaggaaacatgaccacactgagcatattcaaatgtaattgtcagttttcgtgtctccctcccackggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtgcttctctgatgtggctttaagatacttgctctgtcgcccaggctgtagtgtagtgattccatctcagctcactgcaacctccacctcctgggttcgagtgattctcctacctcagactctcaagtagctgggattacaggcatgcaccaccatgcccggctaatttttgtatttttagtagagatggagtttcaccatgttggccaggctggtcttgaactcctgacttcaagtgatctgcccaccttggcctcccaaagctctgggattacagacgtgagccgctgcgcctggccaagatactgagatgtgggggccaggcacagtggctcatgcctgtaatcccaacactctgggaggctaaggctggaggattgcttgaagccaggagtttgagaatagcctggttaacatagtgagagccccatgtttctaaaaatttaaaaaaattagccgagtgtggtggtgtgccacagtagtcccagctactcaggaggctaaggcagggggattgttggagcccgggaggtcaaggctgtatagtaaactgtgatcctgccactgcactctagcctgggtgacagagcaagacactgtctctttaaaaataaataaataaattaaaaagacactgagatttgggggttacttgtaactgtgtcataacctggctccttactgccatcggcatgcctagagggatcccagttttacacatcagaacaacccaagccccagtgtgtcacgccattacatgcttacagcctatttttacaaagtttgaatattgtaatttgcctttaaaaaattgttttaaagatctgcctaggtcarcaaattttatttactctctagaaccatttgattggggtactgccttaagaaataaagcagattccttcagtcgcatgtgggcctggagtcactggaaaatgcagacaaaacaagatctgctgattggcaaggtcatcttgggaagggccatcgtgcagtaaagagcaggtccattaattcaggggggatttacatcagttccatctgcctctttcctaatgggactgtttggttgtgttctttcctggagagattagtgattgaaaggaggagatctagaaagaagagataaaagtttacatttaattttcatgccatgcagcgttctacgaaggcttcctaaggaggctccatactaaattcagacataagtcagaaggcagcttctcccaagacactgttgatgtccagggggtgacagttccatcacaaaagggggttaaaagggtttaggggaagtttagttgtcttccttttatctctaactctaaaacccaactgctggctgaattaaaagtctcttacataatgrtcagaggagttttgagtatcggatctttgtgtacttgytttttaaattcagtcacgtcttaaatagtacttttcactctcctcctctccacaccactttatgtgtttgctagtagcttccatgaaactctatgggtgaacatgtctgcaactctttggcatttaaattttaggtttctgcccctcgtagcagactatctttctagaagcagagctgtaagtctcttttaacaccattttcaagcttggacaggctgacatttttattgaatgggttatctcaatatatatctacttttttgcatcctactttttttagaaaattaaaaatgatatgatgggtgtggtggctcacgcctgtattcccaacactttgggaggccgaggcgggtggatcacaaggtcaggagttcaagaccatcctggttaacacggtgaaaccctgtctctactaaaaagtacaaaaaattagccaggcgtggtggcaggcacctgtagtcccagctactcgggagactgaggcaggagaatggcatgaacctgggaggcagaggtagcagtgagccaagatcgtgccactgcatcccagcctgggcgacagagtgagactccgtctcaaaaaaaaaaaaaaaaaaaaaagataatgatgaaaataatagaatattgatgagaacacccattactctgctcattgttcaaatgaactcatttgagagctctctcctttgtttctgtctttctctcgcatcagcttgcatctgtttgcctatgctataaggcatcagtggttaccaggcagtgttgcattttttccatcccatacctctgtgtgtgttccttatctgtttctaggatgtgccctctgccccgtcacatcacaytctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccaccatggtgaagccccgtctctactaaaaatacaaaaaattagccagctgtggtggcacatgcctgtaatcccagctactcgggaggctgggacagragaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccaycctggaagttgagtgatggggaataaarggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggkacttaaaaattgttagaagagctaaaagagtagttttgaggttgaccttcagaacggcttcctgaataatacagaagtgaccctccaggaaggcccttccactgaagctacaactggagctaagcagatggataagccaaaaccacctccgttgctgtggccccatctccaccacaaggaagctgragaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagaggcaggaagagggaatgaatggtggccaagaattttaaattcctgttcccggccgcccccggaagctccatctttgttgtgagggcttctctgcgtcagtagaggccagctgagctcttattcaccccttattctctggttccctttcaccagcaggtccagctctaaccacagctggagtttaggaaggccaggcagcgtgtgttgaatgccagccactcttctacccagggtcatatccttggatgtttttctgtgcatctgtctttyccgaccctcccgtgattctggaaggaaacacctttccaagctccccagtgaccctggttcatcccggaaatatgcaggaaaagcattatgagcattgcagtgccacatgctgcattggtgtgttacgttatgagaactattagggctgatctctgagaaacttaccagtggtgtgtgatcggaaatcatgtcaccctctgaatgtgggttatgggataaatggctaggtacacaggcttcagagtccagccagccccaggtttggattacagatggttgctgtactagatgaataatgtccccccaaattcgtgtctatctggaacctcagaatgtgacctcatttggaaataaggcctttttaattaaaaaaaawtttttatttaaaaaacagagatagagtcttgccatcttgcccaggctagtctcaaactgttgggctgaagcagttctcctgctttgacctcctaaagtgctgggattacagacatgagccactccacctacccagaaataaggtctttatagatgtaactgaaataaagatagagatgtgaatgtgatcgtactggtttagggtgggccctacatccaataagaatgtccttagcagagacagaacagagacaccgagagaggaaggtgatgccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagcygggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagayaacttgtgatggtttagcttatttagtacaacaaccctgccccttctagtttttatgataacctcattaattgccggtactctcagagccctgattttcttacctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaataaaaagggatcaagatatggattgtaaagtagaaaaatacatgtcaattaaatggatttacatcttaaaaagtggtgaggtagacacacaggcactactcacttcattccttctcatctcaacccgttaggatttggccttcaactgggtagtggaaaaaatatgatccttggcagtctactacgcaaaagcaggaacatcatctgcttttgggtagttaagagttaagtatcactttgagctacaggatcatgattaaaaagcattctgttatcttacttcacaactctccacttttgtaaaagtttaggataccggcagggcagcaaatacctttaaatgattttatttaaatgtcagatttaattaaatccatgaccagaagacaaacccaaaggaaattttcagggagctttagaattttccttttccatgttcaaggtgataaccgtagcataaaactgtcccaaccacatgcaaatgcaagcaggggcattcatcatgaaaatacagctctcaaggcggaagtgcttgttaactttgcactctatagccaagtgcgatgatcagaaaatacatacattgaagacaccagaaaatagtgtatggattggtgattttgactaaractggaatgtgggtgtgtgcactcctcatgttccggtttctgtgatcattcaggcatgcacaggtatcctgatgggtarccaggtcattaggmccaragtcggcagtgtagcatggcaagagaagtcattgcatctccaaactgtgcctaaattgcctgtaatgggttctttgcaacttgcagaaccagatcttaccatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatacatcctgataaatgctgtgccttcctccttcgtctcyctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgttggcaggcacccattagtgttggttacgacttgctaaaagaaaatattaagataaaaattagatcataaatttggagccaccattacgaagcctaaagtgcaaattgccaaacaagtcaagagactcattagcattttatgtaaatcagttattactgttctccacttccttaattatccatgttatttcaatacaaccctttctttgatgtcccaattctatatttaaatagtgcaagatttctatcgtatcctcccgcagaggtttgtgccatgcaaaaaacatgccaagagcagctattttagagactacagggaaatgtttaattggttcatcccatttgagttatgagggtgtattactgagcacataaaatcagaaacatggaaagtactagcttggagaagtttactaaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgkatctgatttttcatttttcattttttttttttctggaagaaagagcagatctggataaagtcagtatacaatgtggtctttggtgmcagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcscaacctcaratgtccctggscacwagcccatctgtatgkctttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgtttaagaatctcagagtaatccagacgttactactccataagcaaatctgggacagtaatcagacaaccagacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggasttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagttctcatcatttatactcgtttcagctaagtcttcttttattgaaataaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggwgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcarggtatargggtcaggcagctgtttgacaggattcttgcaaatgtttttggtttctctgtctactcattacgtacactctgccagaggttgaaaactcaatgttgagatyacatacatcctgaaaacactgkttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccmaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatgaaggcttaaggttttgyctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtacagatctgtaaaatatgaaaacaggaaaacacatggagtcttggagggtagggaagtcttgatgagtaagattgggtctgagataaacctaaaagagggtcaagattttgacrgagggctggaagggaggaacgataggaaactgaccttttttcagatctcttcttgtgcgtggcctggggttaagtgctttacatgcatcccctcattgacttctcagagcagctccataaagagtccctgtgcttcccagtttactctggagacgactgaggctcacagaggttaagccacctacccaggctggcaccgcacactttgttcagagtgggcctggcatacggcatcagttcagcctggccctagacccttttcctcccacaaccatattgcccccagtggagagacaggaaagcagggaagggggcaattgccaagcctgtttctagaatctcaaggatgccatttggtgaagctgaggctggtgcagttactctgtggagacaccagcgtcttggacctagggatggattcagggaggattgtgtcccccagtgacctgctttgtgaaaggtagagaatagattacaggtgcccgagatcctagaacccgtttcttaccatgatggcgttgaggtagaggtagaaagatgggtgaggtggctgggtgcagtgggttgcgcctgtaatcccagcactttgggaggccaaggcgggtggatcacctgaggtcaggagttcgagaccagcttggccatcacagtaaaacccygtctctgctaaaaatacaaaaattagccaggcatggtggtgtgggcctgtaatcccagctacttgtgaggctgaggcaggagagtcacttgatcccggggggcagaggttgcagtgagccaaaattgcaccactgcactccagcctgggtgacagagtgagactccatctcaaaacataagtaaataaataaaaaataaatataatacagacacaggcttttctccccacctcttttaattcttgaaaggaacagtaacaagctcctattcctgtttccttgccaggagaagtattgttttcatataaatcatttgtgacagaagctccttatttttaagtggaaaatgcacatttaataacatgagaataatgtccaaacatcttctcattgatggctgccaagagaacagcagcactcttgctgcctgcagaaagagacactcagagtcaactgttttaggggccatgctgtcattgctgccgcatttgcttaggtgggctctgagcagcagcttcccagacactccgtaaccaatggcagctgagtgcttttgtgccttgcaaatcctctagtcagagcagacctggcttaggaccccagccctaccactaactgactccatgcgctcctatcggttctttattttacctctgcaagcctcagttttctcatctgtaaagtagggataacattagcttcagccctcacaggcttagagtgaagtttaaataagaaaaggtatctaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgacrtaaaaagacctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggccatacttagtggctcacgcctgtaatcccagcactttgggaggccgaggtgggcgcattgcctgaggtcgagagttcgagaccaccctggctaacatggtgaaaccccatctgtaataaaaatgcaaaagatagttgagcgtggtggcgcatgcctgtagtcccagctactttggaggctgaggcaggagaatcacttgaacccgagaggcggagattgcattgagccgagatcatgccacagcctgggcaacagagcaagactgtctcataaataaataaataaataagctggacgtggtggcatgtgcctatggtcccagctacttgggaggctgaggtgggaggatggcttgagcccagaggtagaggctgcagtgagctatgatcttgccactatacatcagtctgggtgacagagcgagactctgtctcaaaaaaccaaaacaaaggtcaattttttttccacattcatctataaaacaataaaggaaacatcctagacacttgaatcagagcccttttaattatgacttcaaaaaacagggctcgtgccacccaagatttcctccatatacaaaaaaaaaaaaaaggaaaaagggaagaagcaaaggggcaatacagggctctgcccattagaatctctagggacagaccgaggtttgagagttcctgctcctgatctcaggggaatcctgaattacaggtgttaacctgattakccccagcccagctcttcgttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagtttttttgtaccagtgaggatgaatgtttctgcatgtgggtagttggcaccagtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaargattgcttgagaagtttgagattggcctgggmaatatagcaagatcccaaccctattaaaaaattaaaaatgaaaataaaattttaaagaaaggtatttctccccttcacggtaatttggagccartacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagcactttgggaggctgaggtgggtggattgcctgagctcaggagggcgggtggattgcctgagctcaggagttggagaccagcctgggcaacaaggcgaaaccccatctctactaaaaacattaaaaaaaaatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattacatgaaaaatagagacaaagtctcgctttgttgcctaggstggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacaktcgtgatttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacarttttggctcgcacatgcttcctttttagctcatgrccgtgcarttcaactcaacctcatggcatctttttatcagctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccaggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttccctcagatttattacgggacctggatgtgatgcaagcatgcccgctggctcaggctgtgcctcacagctgcaacatccctggggtggagaagccatgtgggacctcacagaacactccaccgtccctgctaatggctgagaaaggactctgccctcatggatggggttgggggacctgttatcttcttccaggttaatcttggtttcagctgctttaaactctactttttagtgggacgcatcatactgaactatggaagcaccatagttgtcacctagttgagcttctctttgttcccatatgtttcagtgaagcagttatagcttcagaaaagagggagccaggaaatacacttgtaattcatcactccttttatagtcagagcataggaacactcatagtatgtatcagaaactagtgaacacatgttgttttacagctctgtctgcaaaattgcatcgtgggcctctttggggagtgttctcaatgtgatttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggasagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctgtaatcccaggactttgggaggccgaggcgggcggatcacgaggtcaggagatccagaccatcctggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcaygaagccacatagtaataaacagtttccatatccaagcagctaaggcttgtgccttgcaagttaagtggaacatcasgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctcyatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacagattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaagtctcattcacttctttctatttttcctctctctattgcatattaacccaccatattgagagaatagaaacttttgccttcattatatcacctttacaccccaggacaggtgccctcctcagcggagacaactgtccccctccatcctgcaggagttttgcagccatccttccagccactgcttctctaccggggcaaatyttcccccaagggataattgataatgtctgaggcatttttaattgtcacaacttggggaaggggcaagggattgagggagagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctctccttcctgctgccgtttgaagaaagacatgtttgctttcccttccaccatgattgtaagtttcctgagacctccacagccatgccaaattgtgagtcagttaaatctctttgctgtataaattacccaggcttgcatatgtctttattagtggcatgagaacagactaatacagtcagggatgctgcagaacatctccaaacacacaggactcccaccctctacttccaccccaccaacaaagaatgattcagcccaaaatggcagtagtgaccttgttgagaaatgctgttcaagccatacgtcaccattggaaggttgccaaactgtgctttgcacacacatgctgtctgcacgccttgtatttttctctttgcttagtcctgctcatgctctctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctggaaggctgagtcagaacgattgcttgagctgaattgttcaagactgccctgggcagcacagtgagaccccgtatctacaaaaaataaacaaacttagccaggtgcggaggcattcacctgtattcctagctactcaggaagctgagatgggaggattgcttgggccctggacgtcaaggctgcagtgggccatgatcgtgacactgtactgcagcctgggcgacagaatgagaccctgtctgaaaattaaaaaaagaagaagaaatgtttattgaatgaagacatgaaagcatttggtggaaatagggcacacacatgaatatattcacagttgcaaactcagaaggatactcccaacctggttctttgtcttgtccctccatctgggtgctttccagtcacagcctggatgcatgtatgaataaacttctaccattaagtccctgaattatttaagcactgccagtgattctatataaaccgttcagtaaaatgaatggcatatgcgtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacacttygggaggctgaagtaggctgaagtgggaggatggttagagcctaggagttcgagaccagtctgggcaacaamgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgargcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcytaaggttttattaatatctagtccatttctctcaatctaatagtaaatggaagagaagcamcaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctyttaatttcatgcttcttaaactggggtatgagtggccccaggtttccctgttgggggtactgataccagagttcatttgaagtcattggaaaccaaggcatattttcttaaagagacaactgtttttggtgaataggccatgttgtttatagtwaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagcttgccagcaaccttttagatctctttccttggaaggttcagcaagatgcttgtaaatgtatgttgctttgttgcagacaatgtatatttaaaaagcaattatttgcccatctcttgttcaactcagatattgactgcctttctgtatttctggctgggcattgtttatctccacctcatggtttttactatggttctagaggtctagcctacaaagagaatgcttcccgtccccaccactacccacaggaccctctgcatatctcagaggaatttctcagtgttccagttaattttctctctgtttcctttattacttctaagttccattgcaaaaatatgctgcctgctctgtcagccaccctatatgcctatttagtcccagttttccagcttctatttttttccacataatccctaaccatgataatacaaatataatagaaataattatgtttgtttaaaatatacacagaaccaaatagtcatagagtagtatttcaggtggggggccctcctctagggcagtggagacaatgtcacctgtcgggaacatttggcaatgtctggagacattgttggttgtggtgcggtgacataactattggcatcgagtggatggagggcaggtgtgctactaatcgccctctattgcacagggtggcccttaccacagagaactatgcagctctaaacatgcgcagccccaaggctgagaattgttgatctaggggaagatgtgatttcattcttcatgcttgtaaattattatttaagctgtgaataccctctcttttcccactgaagttgtggttgtaagattctcagagttgagcagactcggcaacattacagaaaaaaaatcaagatgtaaaaaggatttagacgtctggacgtggtggctcatacctgtaatcccagcactttaggaggccgaggcaggtggatcggttgaggtcagagttcaagaccagcctggccaacatggtgaaaccctgtttctactaaaaatataaaaattacctaggcgtggtagtgtgtgcatataatcccagctactctgtaggctgaggcaggaggcagaggttgcggtgagctgagatcgcactacttcattccagcctgggcaacagagagaaactgtgtctcaaaaaataaaataaaataaaatggatttagaaatggtacagtcagaggttaggggtcgggtcaaagcgatccccccagagacctgtggaaagtgtggttctgtctacaagctgcgaccatggtctttactgcttctgcaaatacttgacaaaaagggccacactcttagctggacttttcctccctttcctgaaacaatgcccttcccattgtcaaggcagaagcagcctccactgagaagcgtcagacaccacgtcagtcttgctttccattgctttgctccagtatccatttgaaattcagtgcaaacccataaattccactttgcctctggtagcagcctgcatggtgtgtatattgaacactagaaacacagtaaatccagcccatttattcacattaaccagcaaaggcattctgcatgcccatgtaaatactggaaattactgacatggccttctagaccatgaaaagacagaagcatatggcagaattcatatgtgaacagattgctttttctcataagaacgctttattggaatatcaactattacagctttttgaagttactcttcctgctcttgatttaagtcctgaatcaccccactactctttttttttttccgctgcattctgctatgtatctttacatctgcttcctgcactttctaaatggcctacttaaaccttgaggtaggtccttcagtttcccataaattaataacacatctatgaatatttcccagccagtcttagaagccccagtctattccaataccaggattgtaaacacagggaatagatgaagcaagctgcttctttcaaatgctcttccaatatgaagcaaaatattattgatctagactgcctgctactttcatttaccatgttactrctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagagaaccaagagccagacacagggaacctgtgacaaaaacgaaaaccaataaaaacatatattgagcattgaccaggtgcccaatattttaatgtcccatgggtgtgcatcaggtacgctgtggaaggacagatgtcattccttaaaggggctgsactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcctaagtgacttcagactctatagacagtccctgacttataatggtttgacttagattttttcacctttgggatgctgagaaaaccatacacatccagtagaaaccgaactttacattttgagtttcgatttttttttttcacctgggctagtaatacgtggtaggatactctctcacaatgytaggccacagcagcgagctgcagctyccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgcctttacatcctcatagcttagctcccacttataagtgaaaacacacagtgcttggttttccattcctgagttacttcacttagaataatggtctccagtcccatccaggttgctgaaaatgccatcagttcattccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactctccacactgttttccatagtggttgtactagtttacattcccaccagcagtgtagaagtgttscctgttcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaataccccatgaaggaggtgcaattacccctggcttagggttgagaaaactaagaggtttagtaatgtgcttgaggccatgctacctgtaagcaagaatcactccaggtttttcttgtttcaaaactcctgttaacaactgagttgctatactgttttagtaggtcaagatatactatgtgtttcaaagggcttataaattataaatgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttgkrgtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaatgtaattttgttatatccatatgataaaccttaagtattcttaagccaggtgcagtggaattcccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggctyatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaactggggcactcttggtcttggggaggggaggtggctggggacgcagagggtcctgcrgtgggtggatacttacaacatagaaatgtcctggctcttgatgctggctacaccctcagtaagagatactgtcctagggtcatttttttcaacccacactagttacgtggactgtcttagtcagtccaggctgctataacagaataccgttgactgggtggcttgatttttttttttttctcccagttctggaggctggaagtcagatrtcagggcaccagcatggttggtttctggtgagtgctcttttctgcatttgtggacagctgccttcttgctgtgtcctcacttagtagacagagagagagagagagagagagagagagagagagagaccatctctcttgtgtgtctttcattcatgagaactccacctttgtgaccttattacttctgagaggccctacctccaaacaccatcttattgggtgttctagtttaacatatgcatttggaagagagaggaacatattcagtccatagcatgaaccaaccacgtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacataaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctacttttctctttttcccagcctccccccgatatactcaacatatatctccctctccctccacccacctgcctcccccacactccttctttccctctcctctgcagggagagcttggaaaccaagagtctatgagctcgaagggagcatgcaaaggtgccaggcaggccctcaaagctgggaagctgcagtaggggttctttgggacccagttaagcagtgggcccttgctctgagatgcagtctgctgagctgccatctggggacacatcttgagtttctctccatgatggcgcagctctcagcgtaaagcagtctatggagtgagaagggaaaaggccccagtaataaaaggcaaaggaagccctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagtgagcagtgatgactccactatactccagcctgggtgacagagtgagactttgtctcaaaaataaaatataaaataaaataaaaaggaagaaatagccagtagtgctttcttgtagacagagaagctggtgaaatgatgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactgcaggagagggggattatataggagcttctggaaacagatgccttgggagctctcctccttttccagaactcccacacttgctcttgtagatcatcataggataactctccgctccctttcctaagaaaattgatctaaaaagtaattatggaatcttgcagtgcttgttgggatcagagaaggctcctccgatgatgggatgttaggtagagggctgcagggaccttgcttttagtcaggaggcaaatcaagagccaagagagggaggggtggtcgtgagtttttatgatgttccttctcttctccgctccttcctgacaagagtctgtctcttttctctgtgtgtcataactacccacattcaccccggcagcccatctaccttgtttctctcataagtcagcttctctcccatctttcctgtgaaaatttctaacaaaatgggagttaaggccgggcatggtggctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcrgaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgcttggttttatcttttatacatataatgcacaatacatgtagtgccaacaagaattatagtttctgtaagtagtgtatgattgcccacggatcttcagtaactcattaggcactgacgggctgacatgagcaacaacgagacttagtatctgttgcagctctccatacagtttacgaaactctaatccataaaagccgtttgaaatttccattaggagatttgcacaagtggttaaaattagtcatgcattcttggtctaaactgcaggaagggtatctttactgtgaaaatgattatgacatgttaaaactgtgtaatagtaagcagacagttttccgagctgctgggtgaattctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggttttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcrattggcacctcagatggttcttcctgacagctacccttgcamctgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgctggaataattgacatccaggttatcacagagccttcctatagtgttgattctgatcactcaaataatcttagtgttaaagggtttatttttatttttctaccttcttttaccaccccttactcccatcagagcaccatcagtcttttgggaataaaataattcctcagatatattaaaaagctatagaagcagaagttaacgtacatgcaaaaatctctacatttctcaacaattgtgtaaccactaaatatagggaaagaagtgtgcaaggtataagacattggccatgcgtccttgtctgtgccacctcaccaggagcattgctcctttttatgcacaagcatcagaggttctggacatcttcttgggctagttggtatagcttccttctcagctcattctgcaaggtttgctttggaaaagtctgtgcatctgagctctctcttgccatatcaggaaccgaagtcagaaataaaggctacagatgctcaaaatctgcagtattcaatctttttaaggcccagcatggtgtctcatgcctgtaatcccagggctttgggagactaaggcgggtggatcacttgaggtcaggcattcaggactagcctggccaacatggtgaaaccccatctctactaaaaatacaaaaattagcctggtgtggtggtgcacacctgtagtcccagctagttgggaggctgaggcaggagaactgcactctagcctgtgctagagagcgagactctgtctcaaaaatataaataaataaataaataaataaataaataaataaataaataaagtatctgtccccaagtcacaatgctattcggttggtgcaaaagcaatcgtggtttttgccattacttttaatggaatagtaaataacacttgatctttggtcttctgacctgaaatcccatggctaggattgtcagatagaatacaggacacctggcctgttacagtggctcacacttataatcccagcaccttgggaggcagaggcaggaatatcacctgagcccaggaatttgaggctgcagtgagctatgactgcaccattgcattccagccagagtggtagagcaagaccctgtgtcttaaaacaacaaaaacaaaaacaggacacctggttaaatgtgaatttcaggtaaataacatattttttaaaaatgtatcccatgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccacgctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggccaggagcagttgtttattttctgctatttcgtgtgtttctttttgctggcagtgacatactcctacagggatgtctgcctcatgttgacctgcttgtgtttaccacctagaggcctaagaacaggctttccccgttcaaatcacccagtggcgtgcacacttggggcacctggggactggtttcctgaatggcattgagagtcattactttccacacacagttaactgcagggagatttgtctctgaaagtagtcttcaagaaatgcggcagctgcttctagccgctccatccttccttttcccagtgcgcactaaccctccagagccttccgcatctgctatgcagcattggccacrccagtgggatgcaagaatttatcccttctgttgatgcaattaaagctaatggatctcatatatatatatatatatatatatatttatataaatatattttatatttaaaaatatttatattttatatatttttatatatttatgcaagtatatatctaaatatataaaatakatataaatatatacatatatgtgtatatatagattttgttttttgagacagggtcttgctctgtcactcaggctggagtgcagtggcgtgatcatggctcacygtagcctcaacctcctgggctcaactgattctctcatcttagcctcctgagtggctgggaccgcaggttcatgctaccgtgcccagctaattgtttaattytttgtagagataggatctctccctttgtggcccaggctgatctcaaactcctgagctcaagcgatcctactcactcggcctcccaaagtgctgggattacaggtgtgagccaccatgccaaagcctaagggaccttagaattttttctcctttcttttcacattttgttttgtgcttgcttatttattgaaatctggaccacaaataacttacatgtttgtcaaggccagatttcaggacctaaccaacacccgacaggcatcttagaaagtggagggtgtaagttataaagagagattacttccaacacgtttctttaaagcctgctggctaaattaggtgggrccttmtttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatgctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggcgggagaatcgcttgaacccaggaggcggaggttgcagtcagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcacttyagcctgggtgacaaagtgagactctgtctcaaaaaaaaaaaaaaaaaaaaaaaaaaaagctagtagcacaccccaaaacttctagacagggcatggtgtgagctggartagacaactagttcatggtaacaggaccagcagagctccgtcttgatgctgttattatttggtatctgttaggagctgaattatgtgtccccaaaattcatgtgatgaagccctaattcacagtacctcataatgttactctatttggagatacarccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcrcattttcttatggcaacccctgtagataatacagtcccattctctggggaaacagatacctccgccagggtcctgatctgaatatgatttggggtgatggaacagaaacacccgaggastgtcgttggggaacaggaaacctgtctgtagtcctggctctgtctccaattggctacgagggcttgtgtgtactctagttctctttccgtgacactgcatttggggggaaggtaagggaactggggaaaagaaggcaaaatgatgacttaaagagactgatgaacccaaagctctcttgtgaagccccttctagaataagtccgtctcacgttacagtgcttaggaagtgttagatgtactgtcatttcttcaacatatatgtcctatattagtctattctcacactgcwagtgaagacatacctgagatggggtaatttgtaaaagaaagaagtttaacggactcatagttgcacatggctggggaggccacacgatcatggcggaaggcaaaggaggagcaaaggggcgtcttacatggtggcaggcaagagagcctttgcaagggaactgccctttataaaaccatcagatctcgtgagacttattcactgtcacgagaacagcatgggaaagacctgcccccatgattcagttacctcccaccgagtccctcccatgatacgtggggatgatgggagatacaattcaagatgagattttggtggggacacagacacaccatatcatgtcttggcagccatctatattcaagacactattctaggtatgacataaaggatggcaaaaagtcagttacttaaaagtgtggaagcagagtgtcccaggcggaggaaacggtaaatgagacctctggtagtaagaagcagtgtagcatgtttgagacactgaagtccaatggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatatggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctttgtcttttcttgctgaataagaagctgagagggaggcaattgctgtcactggtccagccggctcagcaactgcacatttgtcaaagttcttcatccccagctttgtgattctctaggttattcattcttctgggatcgtagatggccaccacaggttcactgtggaaagaggggtaggaatttttaccagctgggtctgactccaccccacccccacccctacccaccgttttttgtttttgttttttaagatgaagcctcactctgttgtccaggctggagtgcagtggtgtgatcttgactcattgcaacctccgcctcttgggttcaagcgattctcctgcctcagccgagtagctgggattacaggcacatgccaccacacccagctttttgtatttttaatagagacaggatttcactatgttggccaggctggtctcgaactcctgacttcaggtggtctatccaccttggcctccccaaattctgggattacaggcatgagccaccgtgcccagccgtgtctgaccattttatcaggaaaagcaaaagcttttctagaatctatcaactcccttctgcatgtgtctatttggcatgggctgtgtcacatgacccctgagctgcaaggaatgctgggatacgatggaagcctgccagaggtagagccttgggaagggctgatagggcctctaacctaaatgtccaccaccagaggtattacagaggtttgagcaagaaattatggtggtcccagggatgatgcattctgataatcattatcatcaagaggaatgtctaaaggaaaggggaaaaaaaaaatcagacagtcacattgaaatgaggtccttaagataggccctaatccaatatgcacataaaggggaattttgggcacagagacagaggcagagatagagggaagatgatgtgaagaaaaacatagggccgtgtagaggcagaggcagagattgaaattgtgctatcatgaacgggggaatgtctgggactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccaggtttgctttacctgatctcactggcttcatgtttattatcttattttcagtttcaaaagggcatatcctgccccctttcccaagatcagaggataaggaatgtcttgatgttctcagtcgtaaaattaggctaataacacctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggccattgcatgtttatagtatctcttttttatggctgcccaagttattattttttattggtttgggtacttaatttgcacatttgtaaacaattatgtagttacacagctgttgtaccacagagaccatatgcatttccatgttaagagaaaagtccgtgagggattctcactggataccatcataaaagaattattgtggtgccaaaaaaatttaaaaaaacgactagctcagaagttatcattgtgtttttatagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaartattcatttaggtgacacatatttattgagacactaatatatgccaggaattattctattggtkcctttggaggagacatgaataaaggcatggatgtgactgaggaggtaaaggtgaagaattggggaggggtggatggggctgactcatgacctaaagaacatggcatctggrgctctyttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagtaattttcatatatacttatttcctctgaaatgtattagtaacatttgtaatttaccaaatggaaaatatcacttaactttaagcttcatcaagttaagaatgaatttgtaaccaggggtattatgttttctcttattataacaaacaccaatcaaaaacaaacaaatacatgacgggaaagaaagaaaacccagcatttattggcagtatttttctgcaaaatattatttgtttccctttgcagttttattcattttaagcacgttttcaccaaagtgttctattctaagctagtctcaattcaatttaaagtggaaggtttttttcagtttagataatttacatataaaagcgttactgtacattttatgaaatgactgttttcagaaaacaacgatttcaatttaatcgtattgttattctgcaagttgaaatgcctcactcttgcttcttggtcttactgacaatattccttcttgccctaattttaaatggtgagtgtttgaaaattgatgtgcttcttttagaccctaccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagtgcccaagtgccttcctccaaaagtacattagatactttcttggggagagaagaaattagacaggagctacaaagatggattaaaattaatttggtcctaactaaaagataagttcctcccccatcctcaggatgaaaccaagagcacttctccatcatcaggggagccaagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgtcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctcctgtagtagttatggtcactgactcygggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggrgtcagtgtctgtcaayrtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttctcttttcttttcttttcttttcttttcttttccttttcttttcttttcttttcttttttcttttcttttcttttctacctctcgggattctgagagcatcctgtaatgttggaaagctttctgctaatccgggcattggagtgctctctgggttcactcctgacagttctttattgctttcccacctctgccaaggtcaaaaatggaacttgcttcttgttctcgtatcactcagactaagcagttgatgtaacagataacccccaaatttcagtgatttcacatttaatctgtaaaaaatgaggatttgtttrtagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttmccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctagtgaaatgacaagaatccccagagctgggaaaacatttccatgcaattmcctctcagtttacatcaaaatcakctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggasaatattgaatcatgggggtggttcccccatactgttcttggggtagtgaatgaatctcatgagatctgatggttttataagggggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatggagtttcactcttgttgcctaggctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctccttctccttcttcttctctttgttctccttctagttctcctcctttcttctttcttacttttactcctccctgcttcccttccctccctccctcttcctccctcnnnnnnnnnnnnnnnnnnnnccctcttcctccctccctccctccctccctccctctctccctccctctctccctctctctttttctctttctctctttctctttctgtgtctctcttttctctctctctctctttccttccttccttccttcttttcttccttccttccttttttcttcttttttttggaaacagtcttgctctgtcacccaggttacagtgcagtggcatgatcacggttcactgcagcctcaacctcctggggtcaagtgatcttccccacctcagcctcccgggtagctgggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacartttattagggctttatktaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttattccagcacgtggcatcgccagtcccagtgcccttggcagaccatgcagaatgcatccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggttkcagtgagctgagatccagcctgggtgacagagcaagactycatctcaaagcraaacaaaacaaatgagggtcctcatcagcgtgcctttgacactgtcctctggtcctggtgatctgaatacatcaccrcagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcscttatgtcaagcttctttcagtaacaacwgaaaggctaatagtagtgctgtgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctggagtgcagtggcccagtcacaggttactgcagccttaacctcctgggttcaagtgattctcctgcctcagcctcctgagtagctgtgactacggacacatgccactacacctagttgatttttgtattttttgtagagatggggtcccactgtgttgcccaagctggtctcaaactgaactcctgagctcaagcgattctcccgccttggcctcccaaagtgctaggatgatgataggcaggagccaccacacctggccatggataacatttctataaaatataaccatattttcaaacaaagagaaaagtggcgttgtgctacatttcttctccagtgcttggttccctagaagacagccagattctcacttcttttcctgcattcagtctcttgtgatatcacatggcatgtggcctctgaaaaactccgctgtctagttgtaaaagaatacaagtaagtagtcaagtgacaccttagcattctgatgaaaagagctttgacctcacagagcttctggaagggtctcagagacatccstgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcawtcccagcactttgggaggctgaggcaggyggatcacttgagctcaggaattygagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggaagatctcttccagggcctctggaggaagcacagtcctgctaactcttaatttgggacttctggcttccggaactgcaaaagaacaagtttctgttgtgtgtaggcacccagtttgtggtaatttgttacagcagacatagcaaactaatgcaaatgggctttgcttgaagtccctcagctgctaagggtcagaaacaggatttgaacctacagttttgaggcctgaacctgctatgcagtgctttcttcctgatagtgaaaccactgtggtcccaaacccacagggctctatttagatttaaacaagactatgaatgtaaacagacacagtgcaatgccagatccagagcaatcgaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatatggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaatgatccacccaacctagcctcctaagtagctgggaccacaggtgcatgccaccacgcccggcaatttttttttttttttttttttaagtagagacagggtcttgctgtgttgcccgggatggtcttgaactcctgggctcaagcgatactccctccttatcctcccaaagtgctgggattacaggtataaaccaccaacccagcctcaggagaaataaatcttttaggaaaaaaaagtgacacagttttctcttgtggcttatcacttggaatgtggagagtcatttccattagggaaccaccaggaatcttggcaacttagcagccacaggagatgcagaaactgagtagtgatttaaaaattcagatcactttgtttgttcccctagaataatacattattatcattaacaaagtaactcaacttacagtatcaaatcaactgcagagccattgatattgatgttaccgtactatccaacacattatgtttagtgttgatttaagaaaatgttgattttatttgatgtcatgggtgggaaattgcttgcttttgttttttgagtgaatctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggataaggccagggtgcagactgggcagtagttccctgtcatgaatccactctgcagttgttttataacatgcaacaaaaactaaagtctaatagcactccccaatgccaattttttttctttctcttttttttttttttttttgagagacagggtcttgctttatagcccaagctggagtgcagtggtgccttcacagctctttgcagccttgaactctgggctcaattgatcctcctgcctcagccatctgagtagttgggacaacaggtatgcactaccatgcccagtgaatttaaaaaaacaaacaaacaaaacactttttgtagagaaagggtcttgctatgttggtgaggctagtctcaaactcatgccctcaaatgatcctcctgccgtggtctccaaaagtgctgggattacaggtgtgagcccccaaccccaaaacttgaatctgggccacctttactgacttacttattactatgtagaatatggtacaggtgacgctgcagactcttgaagttaggtcataaaagatgatcctgcttccgtctggttgtgtctctcactcatgggatgcttaccctcaaaatttggccaccatgccatgaggaaactcaatctagcgtaggtaggaagaccgtgagaggcccaaatagagaggaattgaggccgccagtcatagtcagcttcagtcatcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgccactgcactccagcctgggcgacagagtgagaatccgtctcaaaaaataagtaaataaaataactaactaggctaggcacagtgggtcatgcctgccatcccagcactttgggagtccaaggcaagaggatcacttgagcccaggatttcgagaccaacctggacaacgtacagagacctcatctctacaaaaaataaaacagctaggcatagaggcacacctgtggtcccaggtagttgggaggctgaggcgggaggatcctctgcacccaggtagccgaggctccagtgagtcatgatcatgccactgcactgtagcctgggtgataaagtaagatcctgtctggaaaaaaaaaaacacaaaaaactaaataagtcgtccatccgtccatctattcatacacacacgtaaaatgaaaactaaagcaaaagagtagtattaaattctagttagagacttaggatttccagtgactgaaattggaatgttaggtgttaaagacacacatcaaaatgagactcttggttttttttataagtgcaaggattgcaagatacctgaaaagggagtatttttcccccacatgcatctcaggagggtagcctcagatataagcttaggagtcctgaatttatcatcaatatttatatcgctgtttggcccctaacaccttccctatgatagccctaattggaatatagtaaatgtttgttgcatgaatcaacctatttaacctgtgcgtccttaaatcttacggtctgcgggttgacatttctagtgaagggagacatttctttacctacctgggacctcagaccttggacctcactgaacttgagagcagagctggtttatgtgtaactgaacctgatggttagtttcctgtttcaacttgattaggtcccagtcacagggtgcccacatgtttggtcaaacatcactctggggtgtctgtgagtgtgtttctgggtgaggtgaacatttaaatcagtcacctgattacagcagattgttctcaagtgcctgagcttcgtctcatcagctgaaggtctgaatagagcaaatagactgaccctacttcaaagagaactccttctgcctgatgactcaggtggggacttcagtccttttttttttttttttttttttttttttttttttttttttttgagatagggtctggctctgttggctaggctggagtgcagtgacgcaatctcagctcactacaacctcagcctcccaggttcaagcgattctcctgcctcagccttcccgagtagctgggattacaggcacccaccatcatgcccagctaacttttgtgttgttagtagagacagggtttcaccatgttggccaggctggtctcgaactcctgacctcagatgatccacctgccttgacgtcgcaaagtgctgggattacaggggtgagccaccacgtctggcctgacatcagtcttttcctgccttcagacttgaactgaagcatcagcatttcttgtgttttgatcttgctggagttggactgaaactacacatcagttctcctggctctccaccttgcctatagcggatcttgagactttttcttattttatctatctatcaatccattggtcatcaggttctccagagaatcagaaccaataagagatgtcatacacaccacacacaaacacacacacacacacacacacacacacacactaatatggttctgattctctggagaaccctgactaatacagaggcaagatcctgttttgacgtgcttgaactcgaggacttatgccgatgttaactctgagtgttcctgttttatactcagccatacagatgctcagagcatacctgcacaagtcaactttttgtgtctgcaggcatgggcctgccctgtacatgaggagacagcagacagttcctctccctgctgctggcctcttcatcttctcctggcgtcaccacggccaccgtgatgcctggctcaagtactagttctatgtcaatgatggtaccaatggactctaactttagaatgttgttgactgaaggcccctgccccctgccttgctttaggtggaggatctggtcaaggctttgtgaatcaggggatgctccacacctttctgctctctgcaacagggccagggatctgagtcccttcttgtctatccagaaaccgtatacccagtgttctctttctctcacctccgaataggtgggccttcccaatttacctgtgagaaaactagtgtgccacctcaagcgattctggcctctgttgactgtctgaaccctgtgttttgttgagtggtgcagactagagatgaagacagggattcggcttcgcttgctttatcaagggaatgttcttgggacaaatgtgtgacaggtgaggaaaacaacataggaaaggagacagaagtgaagagaagatgtggtctcaaatgaagtctggcttcaggtttatccttggggggctctggaataaaaatcacacctcaaacttgacccgcttgaggccagaaggccgggctgtggtaccttcgtgtcggacagtcataggctatcctcatggggacctgtatgttgccaggtgtcttgggcaaggtggacaaggatgccagcaaagtgaaattttccagagaaggtcacaaaagctaggaaatggcacagcagctgctaaaaggggatctgaccaggccaccaacagcttctgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggcactacaggcgcatgcctccacatctgactaattactaaatttttaaaaatttttttagacactgagtctcaccgtcttgccctggctggtctcaaactcctgggctcatacaattcccctgcctcagaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcaagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatatgtagtcttttattcctcaccctactcccacccttctccctgagttcccaaagtccattgtatcattcttctgcctttgcatcctcatagtttagctcccagtctacagggttatattaaaagaggaaaaggggtataagaatctaggtatcatggatgatgtcctggtcctttgctgagtcccatttttttcttcctcacctgatttcccccatctggcagaaacttttacagagtgtttgcagaagagaagcctgtaaactctggagtgtgtcctgggtggtttgtccttgggccactttattccctcaccgatcccttccaaaggccatgagttcccagtcagtcatttccctatatcagtatttattgttttaatcaattttccccatcccaagagaaaggcaccaacatgagtccatgtgttttaacatagcaggggtttccctgtcagagcccggtggacttctgtggccataagcaagtcaaggtgggctcctaagtggcagctgcccacttccagaaagctagaggttctaattatgtcttcctgaaaaacagttcaattaggtaaagtgacattttttaagcccttgtgtgtgtccgactcataaaagttcagaaggttgttactgagaggagactgcagtcattttaagatttcagtagctgctggagttgagtagataatttttcccctttctaatattatatattaggtgtgctcttgtgtctgggtgaaacagagcaatcacaatgattgttttttcagtatggtaataattaggcataaaatcaatatttatgtgtaatgtgccatttgaagattctccctgtgtatgatgctgggttttacaaaggaaaatctggattcaggtggccaatgaagtgtcacgatataaaaagagaattttgaaataatgagaattccactcctttgggagtattggcatatgttaaaatacaaatatatctgtatttttctcacttttattagaagagtgcaagtttgttcaaaacaactgctggattatctagtccctgaacagccatttatatttttgttacgcttgtggtttttaaatcatcctcatttccttgatcgcatttgcttctcctggctrgaatgtgtaggagacgggtcggggagactgtgcccatttgacagrtgtgaatgcgracagaggctgcagctggttagaccagggctgtgcaaccctagagccattgcctygaccacaaagccacagtctcctagtcctaatattaagaggtaggaggtagatagagattgtcccttaagccacattccattcttcatatttttgtacccattagagtagtgctgatcatttgccttcattgctggggtcccctaaatgcaacttctcatgctgccaatttagtcctggccctaggaagacgtaggtgataggatagaattcaacaactagaagccatggtttcctggttggatagacttcctctgccaccagaataaaggaatagagggttcctcactgtgccccatagctgcaaagtcacaggaagcttgcagcaggccagtggtaacctctgagtgacttctgagttcccagagctaggaccatgacttttcccctggattcttaagtacccggctaaaattgtgtttgccgaatgaaagtgtgatcctggaggccatgttgtttgtggttcatggaagggtgcttgttcagcttggtcaaagcaagatggtcatactgggttttggtgcccagacgttcccaacactcgcagcagagggcattaggatcatgtttagccaacaattttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggaccccggctggctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttmcctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactagggrtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcagaacaggatctggaggcagggaatctaaggctgattcacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcctccagtaacataatgaatgtctggatgtggtatgaagagtattggggtacaccacagcagcgtgtgctctgagaacacagtaaacaggcatttgatacagatcagaaggtccgtaaaggtggtatttgaactaagttttgagagctgggtaagagtttgtgaaaagacagggcttaaggaaggatatagtaagctgaaggcacaggactttagaaacacataggctataactgcaaggtgtgtctcagaaggtacatgtgacgtttcatttttatttgtttgcttttttatagtgactgcatgatcattatatgcagaagacgcttgaaggggccagattaggaagggcccatggtccacactgctttttttttttttttttttttttttttgaaacggagtatctgtctctcacccaggctggagtgcagtggcacagtcttggctcattgcaacatctgcctcctgggttcaagcaattttcttgcctcagcctcccgagtagctgggattacaggcacctgccaccacacctggctaatttttgtatttttagtagagatgaggtttcaccatgttggccaggctagtcttgaattcttgaccttaagtgatccacctgcctcggcctcccaaagtgctgggattacaggcgtgagccactgtgtatttctattaccagcctgcactgcatttctattacccgaaaacagtgtggaaaatattaattacaagggagattaaaaagtaaaactggttggttggcctgaagacccacatggtgacttcactaaagtcattgggtaagcaaagaagagcaacactctagttttcctccaagcttcaacgttttctgtttcctcctatgtcaggtcttaatttccctacctgattcaggctgcgctaagctgacttcatcatgactcctggcttccccagtccctgcttcccagcacataccatttattcagtgttggccagtgacgcctgccactgcattttattgatgaagaaatggagatctcaagaggtaaaaaaaactgactataggagccaagactagtttagagtggagtttgaatatgaacatgcctctgtctgtgaaagccagtgtcccttcagccaggatctttcctggaagaactcagtattaaggcacttgattagttcttcctgttggtggactgattgattacatttgaatctttcagcaagcttttggctgagctgggcatcttccccgccttcctccacctctgccttcaaaagcctgaatttccaaggctttctgccatgagtacttagctttgaaaaacatgagcatatttttcattcttcttgccggcctctccctgtgtcatgcctgttattcttttctccctcaacattgacctaggtcagaaggaccctattttaatgtttagcgtttgggggtcactccatagagaggggtttgtggaaatcctttttttttttttttttttttttgcttctttctgtggatctgtttggaaatgtaacattttaaagcccytcttggctggaggattttttatggtaaacataaaacgttcattgaaacattaaacattttacagctgtttttcagcacataaattttcatagacatccaccccctcactgccacaccccctcatagatttcytcttttcctcctccttctcctcctccctcttcctcctctttttcccccmccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctcaggaaagccagagctaagatggtgcaaaccagcatgtgatttgtccaaggacatcgttttgatatgatgaaccatgggtggtttgggcatttgtcaaagcagggtcagcagaaagctgacgtagttgggtctaaagtacaacaggactgagcatggtggctcacacctgtaattctagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcctgggaagagtggtggggggcactttcttgcccattttttttttttttttttgagatggagtctcgctcttgtcatgcaggctggagtgcagtagcacgatctcggctcattgcaacctctgcctcccgggttcaagcaattctctagcctcagcctcccaaattgctgagagtacaggcatctgcgaccacacctgtctaatttcttatctttctaacacagtttaaatatcactttctcagaggcctaccctgaccatcctacttaagtaacaataataaaataaaaatacccatcatttatgaagtgctcattatgtgccagcgttcttagcatctcccaacaaccctaggagacaggcattacaatgagccttcgtaatgttcagatgaggaaactgaggctaagagagccttggcaagctgagttacttagctagcaaatggtggagtcgaattcaaaccctgcctctcctcacccactctgtttcttttcttttgagcacttaccactttctgaatatgtatacaattgtttcctcgattactgtctgcctcttcttccctagagcgtcagcccatgagcttatccagcctacagaggagatgctgcagcttggcagagcatggattgctcaacataccagagtttagtcctacctctgtctccaagctgctccatgatcaaggataaactataatctttctctctgcctcagtttttccacctgtcagtggaggggcatgctcttggatgcctgagtttttcttagactcagcatcctgcagccgmaataaccatgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccaggcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccraatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcatagtcctccatgaccaagggctgtctgcatgggtacgcagataaaacatgcactgccatggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgttacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctcccyccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctyctgtggtctgtaagaatgggaccaggactcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctattgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttgtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagaaagccatttctgcagagttaaaaaatacgtaggttcagttccttaccaacacgtagacatgttgtgatgaaagaaggaaaggaaggaaggaaggaggaagggaagaaggagggagggagggaaagagagagagagaaaaggaagagaaaggattttctagaaaaagaaaggaaggagggagggaaggtaagaaagaaattaattcccattttagagtaagactggaggcagagtggtcacccagatgaaaatgaataacccaactgtgtctttcttctggtgcctccacgtggaagtgggctgccacaatacttctaaagagaattggcatttttctttaaataaggaggaggatgaggagagagacgacacaaaattcactcacagaagtgaacataaattctaacattggtaaaactttgtctttgttttaaataatcagtcagttgtctcaatccataaaagagtatctcttgtacaatgtctgcttttgagtgattcacttcgatgcgtactgaaaatatacctttaagtagttgagtgacttgaaatattggtaaatgttctttaatattttgtctgtcagtgttagagactatcaggttaaaacaaagatattctttctttcctttttgtttttgacggagtctcacactctgttgcccaggctagagtacagtgatgcgatctcagcttactgcaacctctgcctcctgggttcaagcgattcttctgcctcagccttctgagtagctgggattacaggcacacaccaccacacctggctaatttttgtatttttagtagacacgggatttcgccctgttggccaggctagtttctaactcctgacctcaggcttcccaaagtgctgagattacaggtgtgagccaccatgcctggccaagaatattctttctaatatgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtgtccaataaatttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccagctactcaggaggctgaggtgggaggattgcttgagcctgggaagtcaaggctgcagtgagcaaagatcacaccactgcagtcaagcctgggtgacagggcaagaccctatatcaaaaaaaaaaaaaaaaaaaaaaaaatatatatatatatatatatatatatatatgtatatgtatatgtatatataaatttaaggaagcatagaattgaagaggctattccaaggtcacatgacttttaagtggcagaaacagggggaattctgtctaacacaatccaatttatccatctcaagaaaagagatatgccaaagagaatgattattaaattatcattaatgtgaactcttgtaattactctcataattttctttaggcttatcccattgggcattgctaagtattattagattgtgattataaatggattccgccaggcatttctcttttgctctgtggcagctctttctctagagaacttggtccctggggatgccatcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagtctttggatgttttaattatataaaaaaagcatggaaactgggcattttaattagcaagtacagccttgacacaaataaaggcatggctttggttatgcagtgcatttatttgrttttcttgaaataagaaaaaaagatwtcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactmttaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccaggtaaagcaggccttgttgctattcccctggaccatgatattacatgytgggatgatggggtcttgtgatactgattaatttaaggctgcatgatgatgagggaggaacaaagatgttcttgagtcagtacctgccagagtggctgtatcctggtgttgtaatatcaaataattctacattatttagtaaatagccctgcccgaagcctctcagtgccacacacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgacacatacgctttttctccctttccagctggccctgttgcttaaagtggcagaagtagatgtcatgttggcagacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatggactttagccagaacacactgaaaaacacgagaaaagttggaagaaggaattatttttagtgttctgagaatgctttattgatattcctatgagagtttcattggttactgacgctgtgtactgattgggtaaattctagcatttttacactcctttgtttcaccctgtttgttcattcattcttccgttaaactacaattaagcaactaccatatctaattttaaggtggtggacaaagaatcaaacctaagttggggaatgtggcctctggtgattctcagttcttggtagccatgtctcagcatagtcttctcggacacctaatactactgacctgtataatcgatagggtattgcagacatcagagtatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctaccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaacacaattccaagtgctacctctgcatggcagaaactgtcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcaggccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacattactcaggccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccgggagcaaagctgctgtgggacatgagactctttgaggcagaatacctctcatgcctggagagcattacaggctgcattastctgttttcactctgctgataaagacatacccaagactgtgcaatttacaaaagaaagaggtttaatgaactcacatttccccatgtctggggaggcctcacaatcataatggaaggggaaaggcgcatctcacgtggtggcagagaacagaagagagcttgtgcagggaaactccgctttataataccatcagatctcatgagacttattcactatcatgagcatagcacaggaaagaccctcccccatgattcagttatctcctaccaggcccctcctacaacacgtaagaattatgggagctacaattcaagatgcgatttgggtggggacagagccaaaccatattacaggctaatgactgagcgggggctgtttcttgttgtgttcttataagaactattgcattttctttttcttccaaatatagttaatggcctcatcttttctggactaggtttgtagtagaccataagcaaaagagttcagaaagcacggcctccaagaagtcggatctgcttgtctttatcaatctgtttggattttcctggcccatttactcacaaatttaaaagacatgatgagttttcagggagaactctttagcatttacattttaatttagttttgtttacctgtttagtgccctctcggttcccagaccatcaaactcaccattgtcaccggggagaaatttgtgttggctgaaatctgtagtggttggtctgctgcttttctttctctgctcatctaccctgatagtttccctgtggtttgtggtgggctcacagctcttgacctcaggactctcgctggtctagaggagattggtttgtgggggcgtctgacatgtttgggttctttgtgacatctgggccacccggttgagtctgacaagaaacacttaatacctccttggctttgaagctctcctttgtggcactacaaggtcctctttgaaatcccacattcttttttggatttaggtattaaccccttgctgtgaggagaaagataattgtcaacacacttaggagagaaatcatgcagtaaagctgacccgacatagactaacttaaaactaactagttcattagtgctaacttagttcattagtgctttatctccttgtgtgtgtgagtgtgtgaggggatcaattatatacataagacaaagaccacctaggaaatgtttgagaaactgtgcagtgaggatgaatcaacaagtaaatatcatgagaatttcttagattgaagaaatattactcctatttggtgtcaactctgtgctggccttttcactsaagttctctgatgtaactgcccacagtaatcctgtaaggtatggctaatcatttccattttatagattaggaaaccaaggtcmaaagtggtgaattgatttgaccaaaatcacagacccaggaatttcctcagccaagagcctacagcagctgtgtcttaagactgtgccctttcatccaccctcttggtactcaaagcttggtccatgaaccagcagcttcagcatctgctgagagcttgctggagatacagaatctcaggcctgactgacccgaggcctgctgagtctgaattttaaccagagtctcttggtgactcgtgtgtactttagaaggggaactgctcaccgcccccacttcccactgagtcgaatagacattaagtgagccttccttatgtgctcagcctgtggtgaggctgcaaagacaatacgacccagcccctgtaatgcaaaattcagagcatagggcagcacactgctgccatgagtcgaggtgacacagtactaacagtgggcacagggggctcggggcacagaggaggggtgcttcccagggagactgcccgttggagcttactcctaagctaattgggaggcaggaatccactgtggctgagaacagcagctctgaatttgcactgtctggtttcaagtccaaattctactacatcccagctgtgtattgtggggcaagttacttaacctctctggcctcagtatctgtatctgtaatatggggaatcataaaagcacctacttgttaaggcatattaaatgcaacgctactttgaaggactcatagtagttaacacccagtttggtaagtgttattattgaaggctgagaacagaacgacaaacaacaatcacaacaaaaggctggggaagattttcctggtggggggaccagatgagcaatagatctccatatgcagaggggtaactgagtacgactctgggacttacactagaacattcatattgcaataaagcagatttttcctgagcacctactctgtgccaaagcactattgtaggctgtggagatagggagctgaagtactgaaagcgttacagtcaagggccagaaaaccattgttcaagcaattggcgtatggcttgatctgtgtttattacaaagcgatacttttccttctaagtactgctttacctgcatcctgcaaattttggtatgttgtattttcattctcattaattcaaaatatgttccaatttcccatgtgatttcttcttcgaccctcacatgtttattacagcatttacttgtttctgttcatccagaactcattgaatacctgctatctaccaggcagtggcctggtcacatcttctgacctcaagtagtttatagtccaaaaagacattggctctttgggatagaggcactttttgggggagagaaacatgaatgcaaytttttacatagagtatgaaactctgttccaaatctctcaaactcaggttctttgattcttaaggtatttttcactgccgagttgctgtcattgaaacaaaatctgtcctggtcaccactgtatgcccagcacstagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgggtaggacatgtgaaatatttgctcagagagatccagaagtgttgatctgagtaggatcagctggtgctccaggataaaaatcgtgtcaccacttttgccgaaaagtcactgtgtttctcctgtactcagcaggttacagggtgccatattgttttcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcctaattccctgtgagcttgacacaggaggccgcctcctcctccaggcttacttggaagcattctgtcctcttgttggaagggaaattggtatggtagggaggtgcttcttctgggagtgggtttgtaaaatcaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagtggcagtctaagcctcagtttcctcatctgcaaaatgggtgcaattctagtacctccttcctaaggctgtgaggattcaatgaggtactgcttgcaaagtttctagcacagtgtcttgaacacggtaaacaacttacctaggtctgatctcatttgatattgttgctcatagcaaaggtttgttgagtttactacggatataacacttgttcttttttaaaataacttttaaaaacgcaagtgttgaattatctgcattgtgcctttagggcatacacatctgcttacaatattttttgagctttcagaaaacttaagatatggttgagggatgcaggaaggaacaggacaagaacccagatccctgcccaacaggacagtggaagggaagtctcagcatctcgaaatgagtgcctggagaggatgggtggcggctgtgcggggatgtggtagggtgatggtccttgaaggatgctgcagatcacagtggccccacagtgtggggattggggtgggatatgtgacaacaaaggcatccctggcagaggatccagcacgagcaaaggcagaaagtccaggaagtgtcaggaatgagaagagcccagtagaggatgggcttagggacagtgatgagaccttctggtagaggcgttgaacactagggtgagggctttgctctgacttcaggaagcaggtgagaggccctgaaatttccacgtaagattcggggccgggcacggtggctcatacttataatcccagcactttgggaggctgaggcgggtggaccacctgaggtcaggagttcgagaccagcctggccaacatggtgaaaccccatctctactaaaagtacaaaaattagccaggtgtgatagcgggcgcctgtaaccctggctactcgggaggctgaggtgggagaattgcttgaacccgggaggcagacgttgcagtgagccgagattgtgccactgcactgcagcttgggaaacagagtgagactctgtctaaaaaaaaagaagagttggatcacagcaaaggtgagctttaatgagttcactctggcagttgtgccgaggagggactggcatggagagaaaacagaggcaaaaatcacaacctctgtcagagaactcatcgcactatttctgtcctgccctgggatggtggagcctaagggaacagagaggacagagtgggtggcacaggcattgcggaggcagaaatttacgtggcttccatgcccattggtgtgaggagtgaggggtgatcagggatcccagtggcttgaaagtataacaaaagtatgactagatccaggaaatacagctggagagacccaagtctgcacagaaaaggtttacagagcccaggcacacagatgacatgagcagttccaaaggagtgggacggggtgaatgatttgtggtcagaggtgtggtcacacataccgtcccctgatagtcggtgggaactgggtcaggttccatttgccaggggcaggacatactgcgtgccttggccttttctgggctactcaaaaaaggattccaccaggtaaacttgaatcacctagcgctggtagaaagccttgctcttcgtcatctctcctgtgtatcgctagccttattaaaatgtgcagaggagaccgggcatggtagcacacttgtaatctcagcacttggagaggctgaggtgggagaattgcttgaggctatggcttcaaaaccagcctgggcaacacagcaagaccccacgtcttaaaaaaatttagccggctgtcgtgtctcctccgtgtagtcccagctattcaggcagctgaggcaggagggctgcttgagctcaggaggtggaggctgaagtgagctgtgattgtgctgttgcactccagcctgggcgacagagggacagcttgtctccttgtctctaaaaaagaaaaacatgctcagaggccttgtgagttagctctctccaaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcctcccaaggagctagaggtgcatgccaccatgcctggctttttaaatttatttttattattatttttttatttttagtagagacagattttgccgtgttgccctggctgatcttgaactcctgtgctccggtcatccacccgcctgggcttcccaaagcgctgagatgactgcgccaccacacctgccacaaaatttctttgttatggctgaataatgtttctgtgtgagtgtgtgtgtgtctgtgtgtgtgtgtgtgtgtgtgtgtgtktttgaataatactcctatgaacattgtaccaatatctattcagatctctgctttcgattcttctgcatrtatacctaggagtgaaattgctgcgtcgtttcgtatctgtgtgcttaaccttttgagaaactgccaaactgtcttcaacagcagccgcatcattttacattcccaccagcagtgcatcaggattctagttgctccacatctacccaatacttattttacttaaaaaaatagaatagccatctgagtgaagtgttacctccctgcagtgttgattcccatttccctaatgatgttaagcgtactttcacgtgcctactggccgtttgtgtatcttctttggagaaagtaacatccatttttgatactcacatggctttttggttctatttttgctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcggggggtcggttattttataagcaaagaagtacagccagtatgattttgaagcaactaggccccagtagaaaaaagttggagagtgaaatctcaagcaagccaaaaagtgatagatgagttaaaaaaaaaaaaaaaaaaaaaaaaaaaaaagttgcctggcttggtgcagtggctcatgcctgtactcccagcactttgggaggctgaggtgggcggatcatctgaggtgaggagtttgagaccacactggccaacatgttgaaacccgctctctactaaaaatacaacaattagccaggtgtggtggcgcacgcctgtaatcccagctactcaccaggctgagagtggaaaatcacttgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaattgcccagcgttttaattatcggcgtgttttatgcttttgtgaaatgctcatttcacagcttgctggtgggtctttttgtggaacgagaaagtgaatattcacaccagaaatgaggtactgaccctgaagggctttccagtcaaagagaaaggagagcatgacccgccaatgccgttgtttgtaagcaggaagctgacgctgcgccatggtgtaggggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgtkgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaacccygtctctactaaaaatacaaaagtkagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggatctggactgggccatggcccattggatggcagaaaggttctcactgaagcccccataaaggtgggactcactgggaaaccgctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagccgagcaatgctaaatgtgcctggtactgagacgtcatctgtggacggttggcaccgatgctaatcagtgctatgggaaaataggcagagcgaggagcgtaagaattattatgtgtgctgtttgatagagactgtacaaggaagacctctctaaaaaggtgacatttggagcagagacatgaaggaagggattgctggaggcagaacattctaggcagaaggaaccgcacgtgcaaaggccctcaggtcagccggcatggcatgcaagtaagccacctgcaacacagcaggtgtggatgaagggaagagaattagcatttggccagagcacgcattttaagggatggagatccatttggatagtcttgaacacagaactgaccggaactgacttactctttgaaaagatcgctctggctgctgtgttgagtggattggtaagggacaggtggtgaagactgaaacagggtatccagttaggaagctaccacagtgatccaacccccagcttctgttgaggttgaagaacmtgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggaggtggaggttgcagtgagccaagattgtgccactgcacttcagcttgggcaacagagtaagactctgtctcacaataaataaataaataaataaataaataaataaataaataagagttggatcacagcaaaggtgagctttaacgagttcagtctagctctctcacaaaaaaaaagttaaaatgacaaattttgtgttacatacattgtactacaataaaaaccatttttttgaaaagaatagtacaaaaatgatacttccctctcagtgtattttaccaagggattattagtgtatatgtgtgttcttactggaaatgttaattggacttgtaattctttttttaacttgtattttgggttcaggggtacatgtgcaggtttgttatataggtaacttcatgtcacaaaggtttgttgaacagattatttcatcacgcaggtaataagccttgtatccaatagttatttttctgatcctctccttcctctctccctctaccctcaggcaggccccagtgtctgttgttctttctttgtgtccttgagttttcatcatttagcttccacttgtaagtgaggccatgcagtatttgattttctcttcctgcattagtttgctgaggataatggcttctagccccgtccgtgttctcgcagaagacatgatcgcattcttttatatggctgcatagtattccatggtgtatattcactactttttttttaatccaatctgtcatttgtggacatttaggttgattccagtagacgtgtaattcttcttggaaatgttaatcttgatcatttggttaatgtgatgacttctgggttctgcagtgtgaagttattatcttcccttttgtaggtaacaaatactttggaagagattaaacaaacaaataaaaaagtggtgattgttattaccagcatggctactactagctaattccaggcttcaagccactggggcataggcatatgtttagctcattccacaggaggggaacagaggctcaaagaacctaggtaagttggccaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaacaaacaaacaaaagaaacaaacaaacaaacaaaaagaaattaggtaacttgctcagtggctagtgagtggctagattgtaagcttcatgagggcaggggactttgacgattttgtcggtatcctaagcccctagaacagtgcctaaacatttgttgggcagttaatatatatttgttctattaataagtagagcccgagtttgtgttctccgattccacaccccatgttccttctactacaacttctggctctggcttctggactgtcagtcattagcactccctatccctaagatttcaggaatgttcagctgttgcctagcttggaatggaccatcctctggtcccacccatgggtaagtcattggctgcagagcgcagacatttggctcccttcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttttcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccttctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccgagatcgcgccactgcactccagtctggtgacagagcgagacaatgtctcaaaaaaaaagaaagagttctgaatgatgataggtgttggaatccacgttggtgtgtctcatgtcattttttcgggcagtttcttgacagacccattttgtgtgtgtgtgtgtgtgtgtgtgtgtgtgtgtgtgcgcgtgcgcacacgcatgagcctgtacgtgtccccctccccccccacacatatgcacataagatagcataaggtagttccctggcacatggcgttgttcttaaccatgaggtgctcccaggctccgggcagttccttgaaagactcattgtctgtgtggggggaggggaggctgtacatgtccccacccaacacacacacatacacacacatgggcacatatgatagcataaggcaattcctggcacatggcattgttctgaactgtgaggtgctcccaggagatcttgtgcttcctatcacatgcccattctgcaagtccatccccttattgagcagatgtttaccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctgtgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcractcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcatggtcggggaagcctcagaaaacttacgatcatggtggaaaggaagctagtgcaccttacatggcggcaggcaagaggggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattrggaatgaagtttaggtcagaaaagtttcagtgattattttttcagaatcattgtttcttggtttctagggtccaacatgccattgttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctggacttttagtttaattttttgtaatttaaataatttaagtagctgatgtgtctagtggctgtcgtattggaaagcacagagtagacattgcaaatacagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcrcctaaaattctctcttctacatatctcastgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtagaagccatatggatactttttctcaagtsttgaaataaattaatggtgtggccatggttctcgtacttcaggtccctgtgagcccctggggtcctacacaacttggggtaatgctatggtcacctgcatcccctcctctccagycctcacctggttttctcttctccttccaagaaaaaacaccyataccattcttaacatctctggaagctgggggtcaggagagggrgatccataaagttcttgtcttccccgaytcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagaggattccagcrcaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggmggaaaaatcatccaaactacttggtaattgaattcaagagtgatggaccaaaaattattaatgcattcccttccstccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgcaatcaatcattgataagatgtactgttattttatgtttcactaagagtgcgaagaacattgttaattatacaatgatccaaaaatgtcttctctctcagaatgtattgttttatatctattagaaaggctcttttgacttaggcatagatttctcatacatcaggccatttctatgcctgcctgtgaacacagggattttgaattacaatactgaatcctagtgtgatctttctgaagtcattttaattatcacttaaactcaatatggaaagcatcagcaatgcacctatatgcacaaaaatgagcagctatgatcaagttatcaggaaaaaccaaaacaaaacaaaagcacatctccatcatttataatggcccatcatttataatggctgcctgataattggagatacatgcaccagacttgacttaactgttctcttagtcatcagacatttagatttcaacatgctcctgttaagctctccttacagtgtgtgtggcactgtgcagttgaatgaaacatgccatggccagtggaaacaggcttgggctgatggagagggcctacagggccaggccttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaagccctatgcctttgggaaggagaggaaggactaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctgatggtggtgatggtgataggagggtgatggtgatgatgatggtgataagatgctgatggtggtgatgatgatggtgatatgacgctgatgatggtgatgacgatgataatggtgatgatgatggtgatgacaatggtgataatgatgtcgataatgatggtgatgctggtgctgttggtgatggtgatgctggtgatgatgataatgatagtggtgataatgttggtgatggtgggatgatgttgatgttgatgataatgatgatgatagtgatgatgatatcaacagataccatgtactgagcacttactttgtaccatgcaatgcttatggttttttaaatgcatttacaccaaattcttataacaaccctataagtcagtgccattgcttttcccatgtaacgtgcacatcattcaatcactcaacccttgtcataggtagatactattatcctccttttatagatgaggaaaccttggcttagaagggataagctcaagttcacaggcagaaaagagacagccagtcaagccctgactccttttgtgaccctgatgagattacaggtcctcagtctcctcattgtatctgaagactaaagaatcagaaatttgtgactccacttagtttttctccacccmggagccctcaggccgctggtgagtgaagttcttacccattagggattattaatatactagataagagtacagtctctggagctaggcttgtgactttgaacaaattattttatctctctgagctcagtcycctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttacagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctcttaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattgkataatggttttaaaatacyaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggccaggctggttttgaactcctgacctccggtgatctgcctgtctccgcctcccaaagtgctgggattacaggcgtgagccaccgcgcctggcctgaattaatattttctaccccactttcttaagtcgagacaatcaataaagcaataaatgacacctggatttgtagcgaatgtctatttccatggtgtaaatagtggtaccctgagcaattttaagttataaatatgagatcactgaaagtggagttggggaacacgttattatatagtattttcaccacacacaggatacagtmaatgacttcaagagcataggtaacagtaaaatgtagtaaaasaatttagaagtcatgagttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccccctaaaagtaactctgtgcccatagttggcagtttgtcatatcactcaatcactgtttcctttaaagagcttatcattaaagacagcaggcagttacacaacatcttctacatgccaagaatgtttctaatacatgctttatggatttttaaattgtggtaagatttacataatgtaaaatttaccactttggggctgggcgtggtgactcacgcctgtaatcccaacactttgggaggctgaggtgggtggatcacttggggtgaagagttagagatgagcctgggcaacatgatgaaaccctgtctctactaaaaatacacaaattagccaggtgtggtgctgggtgcctgtaatcccaggtattcaggaggctgaggcaggagaatcgcttgaacctgggaggcggaggttgcagtgagccaagattgcaccactggactccagcctgggcgacagagtgagactgtgtctcaaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcatattttggggagtggcattgctgggtaatatggcaattttatatttaactttcagaggagccaccaaattgttttccacggaggctgcaccattttatatttccacttgcagtatatgaaggttccaatttctccacatccttgmcaacactttattttctgttttctttgaaggtatgaaattgtatcgtggttttgatttgcatttccctcatgattaatgatgttgagtatttttatgtggttattggttatttgtatcttttttaaaatagaaatgttgattcaagtcctttgcccagtttttaactgggtcatctggcttttgttgttgagttgtaaaagttgtttatatattttggatactagacccttatcgtataaatcctttgcaaacattttctctcaatctatgggtaggcttttttactctttttatagtgtcttttgatgaacaaagattttaaatcttgatgaagtccmctttatctattttggatgttgttgcttctgtttttggtgttgtatctaagaatccattgccaaatccaaggacataaacatttactcctgtggtgttatgatatatatagggttcctggctcataactctcatagcccttgttgcagtctattgttacaatattgcstgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaagtggtagcaagtgttttcctgagttctgtcatctgctccagcaaattaatcaaacccaaagagggggttatgggaacttccacctgaagcccctcagccagacattctgaagtctctgacttgctattggtgtctgggggtatggggggcagtcttggggactgagcctccaacctccaactaactccacgtagacagtgtcaggattgaattggaggactcccagctgctgtcccctgcttagtatgtggggaaagttgagttgtaaaagttgtttatatattttggaaactagacccttatcatataaatgatttgcaaacattttctctcattctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctrtccttatgccattgccacaytgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttygttaattcctgtgaccatatggcagcatggttaggatcttgggcttcyaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaaatttattttatttttttgggacagggtcttgctctgttgcccgggctggagtgcagtggtgcgatctcagctcactgcaacctgcttcctgggttcaggtgattgtcctgcctcagcctccctagtagctgggattacaggcgcacgccagcacgcctgactgatttctgtattttcagtagagatggggtttcatcatgttggccaggctgctctcaaactcctgacatcaagtgatttgcccgccccagcctcccaaagtgctgggattacaggtgtgagccaccgtgcccagctcagcattattatttttagtctacacacagtgaacttaaatctcctctagaaaagtcagaaggtctacstacaactttaagagttcagccaaaagagaccagtatctactaccgtggacaaccctatttaacatggaggagataagcagaaactgaaaagaggagcctgttttctctctggcagattaattttctttctttcttcacccatgccttggacatgaaacacaagtacaaaggttcagagaaaatcaaaacaagactgtggtttacaaataagtagtactagtaacatctcactgttggctgggcacagtgactcatgcctgtaaccctagcactttgggaggcagaagtgggaggatcacttaagcctagggttgaagaccagcctgggcaacatggtgaaacctcatttctacaaaaaatacaaaaattagccgggcgttttggtgcttgcttgtggtcccagctactcaggaggctgaggtgggaggatcacctgagcccaggagatggaggttgcagtgagccaagattacaccattgcactccaccctgggtgacagatccagaccctgtctcaaaaaaaaaaaaaaaaaaaaaaagtgaaaaaaaggaaaatcttcgttgttcttcatcagaagcctccacacagggcccctgaaggaagggcagggaagaagggggttggaggtcagtgggaggaataactctgtgactcagtgctttcctgactaccatctggatgtgggctgtatctgcgtaaggtgccgggacagggcggcctcatgaactcatgggaagcaaacacacaccctccctccgatccaccaggcactcgggtttcctgtgtgtctggtgatgtgctgggtgttgtggatctggactsaacggcagtctcaggtttatgtattaggaagcattcagcaggcaggagcagccgatctgagactggcatgggcagtggagacatcattcatctcctgaaacrtaatttggaggagactgttccagggctggctgagtgactccttgatgtcagcactttgccctgtcgtggtcttggcctttctcttgtgttccccagatgggtttcactgctctaaggatcataccttcgcaggccatctgaagttagtgaatctgaggcatacagaagggctgggtgcggtggctcatacctgtaatcccagcactttgggataatgagatgggtggatcacctgaggtcagaagttcgagaccagcctggccaacatgatgaaaccccgtctctactaaaaatgcaaaaaattagctgggatttggtggcgcctgcctataattgcagctacttggaaggctgaggcgggagaatcacttgaaccrgagaggcagaggttgcagtgagccgagatcgcgccactgcactgcagcctgggcgacagtgaaacttttgtctcaaaaacaacaacaacaacaacaacaaacaaacaagaaacaaaaaatacataraagaggccttctcttcacaagtttttcttattgttttttgtttttttaagggaggaaatttctttcagaagtcagtactggacattcccttatttcaccttgagctacacatcccatagtcagcttagccctgtccctggtgcgggggagcaggackgttgcctgtatcccttagtcattgccgcaggcttgctgcatcacaaaccaccattagacctcagtggcccgcagcaataaacattcgattctcgccatctctgggtttgaggtgaccttggctaagctcccctgcattgctctgctcatctttctcacgagtctggcaatggggctgggaatgggctgatctaggctggacttggctggagtaacccagccccaccttggatctctctcctctacttcccacatgtatccttttcatggttaaaggtagaaacagaaaaaaacaggcagaaacataaaaagctcggagatggcttcctattgcttcttcattctgggccagagcaaatcatatggtcgtrctccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccarttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatatagaagaggatgtagggcaggtagggctcagaargacccatgccatatagcaaagttcttagtaacacaggctttgggttacagcaggctagattcaaatcytgctgtggtcagaatgtctgtgtcaccccagcattcatttgttaggagatggggtcttttgggagatgatttggacatgaagacagagcctgcataattgcatgagtgcccttataaaagtgaccccagaagctgccttgcttcttccaccatgtgagaaaacagcaagaagaatatccatgaatctatgaggaggcgggactctggccagacattgaatttgctgcttccttgatcttggacttcccagcttccagaaccatgagmaataaatttctttttttcaaagctccccaggagtctctctcggtctgttctggctcaggaagctkccttatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgyagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagtaatgggagttggaggcttaacastgatctttgagctggcgatttttccagccaactcattttggacgttggtgcttaagcatatcctgttttcgagggtggtgttggtggtggaggaggtgatggtgatgatattgataatgacagcaagaatgtcttacatttatagagtgttcaaaaggtgccagatattgtgctaagtgctttgcgggcattatgttattcacacttcacagatattctctttctacatgtaaggaaaaaaaggcataaatactttatataatttactcaggattttaagtagagggtagattttaagtccaggcagtccaaccccctgaaagctgactctttaacaccatatgcttctgtcttcctggctgttttgtgaatgagtaggatggaaaggagatccttgaattgggaaggctacccatggactacaactagtacttgtcttcaacctccatctagatggagtgctcacaagatcctctacatcaaacctggcttcttagtccactgctgagtcttcccaattctgaaaaaaaggattcagggtataatttctcacacagatttctgggacagtgctttcttggagcaccacgcctcactaatggaacactcatgtataattctggcttttgaatttttatttttttattaacatacacagtcagcattgggtgtggctctggggattcattctagtgggcaagtctcatatttctcaacctcaggtttttcatctgtaaatggggacaatactgacatctasctaatgtccttgaggatggaatgagatattgagtataaagtatctagtagagtggctagcgtatagtgagtacccaataaatgcaatagatgttggcttttattactgtcaagtggaaacaaaagtataaggtttaagtaagcgaacgaaatggaagataattgaggaagaaaatcagatgatgtctaagataaggcaaagaacattttgtgaatgtttaaatatcctaagacccactaaggaagtttgtggcaatatttgctcaaagacagtatatataataaatactttagactggytaagagaatggctctgaatgtctacctagctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgcagtggtgcgatctcggctcactgcaaattctgcctgctaagatcaactgattctcctgcctcagccttccaagtagctgggattataggcatgagccaccatgcctggctaatttttgtatttttagtagtgccggggtttcaccatgttggccagtctggtctggaacacctgatctcaagtgatccacccacctcagcctcctaaagtgttggggttgcaggcgtgagccactgtgctgggccccaactttctttatcaatagaagtggggaaatcgtacctgccctgtctgcctcattggatgtggaagaaatgacataatccatgagagtggcttctgaatgaagagaacctgctaaagggaagacatgatctcaagtcagccacctctgacccaaataagaacacataattacaagactgtattgtataatcatgcaggacacaaggtatgcaattttaagggtcaaagtggtaaaaaaaaaaaaaaaaaaaggaaaatcaaatataaaaaggcagccccgacaggtacgagcttgtagtcatttccccaaatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagtcaaaaatccactggaggccaggtgcgttagctcatgcctgtaatcccarcactttgggaggtcgaggcaggaggatctcttgaggctaggagctcgagaacagtctgggcaacatagcaagtctctgtctctacaaaaaatacaaaaattagctgcgcgtggtggcgcgtgcctgtagtcctagctactcaagaggctgacatgggaggattgattgagcccaagaggtcaagacggtagtgaktcrtggtcacaccactgccctcaaccctgggtgacagggtgagaccctgtctctaaaaacaaaagcaaagtctactaaaaattcactggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgcgggaacaaaagctattttatcattaatatgccgcttttttgttatgtactcatgccccagaaattattgtacagcctgtacttgagtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagctatgggatgtacagcagagtataacaatgataaatgatgttgtgtgtaatttttctactattaacataaagtaatataaactgaaggacactggtctattgagagacttagaagctaatgttccatatcagatgcggccaatgtcaggactgaatacagattaggcagtgtccttttctccccaggggaattaaagtttgagacaccacttgctgccagtggttttatggcattttgttggggccggtggtgcctttcttggtctattaattcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgcygtctctttaacggagagttcatgggcwgggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaagrttttcttatgaaactgattttwctcaccagggatagagtctcaaagttggaggtattttatgttgttttaaataatatcgtcatcacatgtcattttagaccccaaaagtccactccgaatctctgcktatggaattgaggaggggtgaggctgtcagaagccgagggacttggccaaggtcacatggctttggacggcccccctgaaccttggagctcatgttctgtggcactttgcatactgacctttctgctcttttatgctgcctgctctctaatattgtccaaaaaccttctctaaagaaagtacacaaatggagagagggggaattggrcatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcctccatctcaggcactagttaggaacttcccccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcactaaaaacagggttagaatatcttcaatgcaattataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaaggctagaccctatctcaaaaataaacaaacccttgctattttagcttccgatgaggatatttatccttctagcatttgaatgcagccaaagtccttactgggcaaatttttgagctctcaccccacattaacaatttctctccttaactttgtttctgaatgaagttatccacagagttttaaagtgagtggtgagttgtggatacctcttccgagcaggtgcacccccatcctgccattgtccctctccttagtgtatatggattgatgacatttcagtttcagacaaagggacatttcattttttttaggagattaaagctgtgtaagatatacaatttaaactgaatgttgatattttatagattgttgagtccgattgtcctgatctaaaattaactggttttgtgatttggtgtaaatcgcttaacctctttcaatgttttttcagcaaaatggggtaagaacagaatctgccttgcagagaattaaccgagatgatgtgtggaaagggcctatcccagaggctggtgtaccatggtggcttctyctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtagtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcactttgagaggccaaggcaggcagattacttgaggtcaggagttcaagatcagcctgggcaatatggtgaagccccgtctctactaaaaatagagaagttagccaggtgtggtggtgggcgcctgtaatcccagctacatgggaggccgaagcaggagaattgcttgaacccaggagggagaggttgcagtgagacaagatgatgccattgcactccagcctgggtcacagagcaagacttcatctgaaaaaaaaaaaaaaaaaaaaaaaaaaaaaaaaaacagaaaaatgaacgagtgagtggcaagaaagatgaaatgattttcatcaccaggcctgccatggaattcatggtgccttgtactgtggccagtaggtgcaagagtatctagtaggtgctttatttttaaaaaatgtcttggaatcagtcatagtttaatatcaattatatataaattagtcttgcaggatccaacagttctgatttattccactcacacaacaagtcagttcttaacacaaaccacataggttcttccttaaataaaaagctgtggctatgaagaagtgagagtttttttttttttcctctccaaaccaccacgtgctcttgtgtgttattgtagtggcttcgcagagtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcattgaccttgtgggctcaagcaatcctcctgcctcagcctcccaagtagcttagaaccacaggcatataccaccatacctggacatgtttttaactttaatttttatttttgtagagatgaggtctccctatgttgcccaggttgctctcaaactcctaggctcaagcagtcttcccaccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatrgtcagagctcaaaaattgagtactgcttygtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacmcttctttccttcakctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcrccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatagaaaagaaaaaaaaatcctgtttataccttaggcattctgtgatccttasgatgtagccatgacagtattacgggttttaaaagccacccaagtaatctaaatttcctccaaactaacaattcctgaaagattgaaatattgctaccaatgtgtacggatggtttccattgatatttgggaagtttccatttgtatttgggaagctttgcatgagcaaaatgcccctttctcctgatatttgcaacccatcttaaaaataaaagtacttttctgcatgtggtcttgtacatgaaattaagaatatcactaccaaaatatcaaaatttaaggactagattgtgaaatgtttaaggtaggcaaagaatatttaaccaagaaaggaaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatgtttttcgtagagtcagggtttcacagtgttatgcaggatggtctcgatctcctgacatcgtgatccgcccgcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccagsaacatttttctcatcttttgaacattagggamtaacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttctacaaccaagaccttgaacttttkcctctcaggatttctttcatgagaacccattttctggccatttggatatcattgatgagggaattgaagcatttccctattctttagagtttcattaaagtttgactatattccagtaacaattgttgcataacaaaccacccccaaatttagtggcttaaaacaacaacatttattttgttcaggaatctgtagtttcagcagggctctsaggaacagcttgtctctgctccagcatcagctgaagcagcttgaaagccagggtctgagatcatctgaaggttgttcactcatgagtctgaggawtgatgctgactggtgggtgggacccttgctggagggtctattggctggaacacctacacattgtctccatgtaccctgagcttcctcacaatatggcggctgggttccaagggtgagcgtcccaagagaaagaaccaagcagatgctgcattgccttttatggccttccatagaagttacatagccctaggttttcctgcattctattttttaggctgtcagacccaccccaaccaggtttgcagtgagaggaaatagaccccacctcttctggaagagaatgtgggactggacatactgccatggccacttttgaaagatacagtctgccacataagcaaacagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaaatgacagctataacatcaagggcccgggtttattttaaatgtttttgcttctacatggattctaattaacgacagtggctaaaacctgattcaaatgtggcaaatgtggagtgccatgggatgaagccagtcaatttcatctaggagcattttatggcttatggaaagaaatattctcttagattgaagggcgccagcctgtaatgggcatcagctgattctcagaaaraagaaacaacgtactgttacataattggggcttctccaaagtggcctgaccaaactgtagagctgcttgtttgtctgatacggtagccattagccacatgtggctatttaaactgaaatgaattaaagttgtataacatttgtaaaaatcacttcttcggtttcattaactagcctcatttcaagtgctcagtagctacatgtacctaacacattggacagcacggttacagaacgttttcatttcatcggacagtttaactgctttggagactggttctcctttttctttttccatgttcactccagaattaaagtcaaccagttcaaatgtcccatctttccccacagacatttgtgctcaaaggcatccccttccccatttggagactctcctagggcctaggcccaagcaaccaggactccctgtagtcaaccccactcctcaatttttggcacccatgttattccacctcaagatcatgtcctcttttaaccyctctgaatatgctcctcctgtgatacccatagggaccctgaacctctagtcctcaagagcagtcattcacccctttggactatggatccctttgcaacccaggaacaactactgtatggccacttcaaacctgtatatgctgcaagtattttatactaggtagggtaaataataggtcttagatataggtgcaaataattttcaaatatgggtaaatgctattgggatgtgtaaagtagaaatccattttaaagcgttattgaatccatactaacctgatcattacatatttactaattgatgattactaaaaatgtggacctttgtgaatttccgatgtcayagaagggtgttcttaactggaaaagtcagtagccaacattctgggaagtagaggcctcttcctcactgcttcattggtttaaaataaactccaacagaaaaacatgccatcatctttaatttcctgcatcagctaagcatttatttcatgtagtcctcacactagattgagtggttccatattaatatcctacgtcaaagatgagtaaattgagatgcgkaggttctaatttgcccagtgtcgtggtgtgtgatcttgaccactagcctaaactgctattttatgtccacccatcaacctctacggctgcccctcatttgaacacacaaaatatagttgtgyggcttggtggagccatctaaattccgttaggccatttgccaatgctgctattaggggcgaaatgtcatgcgcttgatctaaatgtacttaggagaattctcaggacctgatgaattattattcggaattttatggcctcacaggttgcaggcttcataccaactgcagctaatgagctatgggccccgagaaacactgaggacacacggcgttctgcacacagagtgggctgtttctgtctgttctccccctgcacccttctcagatgcaatctcaagtcataggagaacttgtgcaaatgtttctcctggatggtttcctttagagcatgtgtcctataacttgaaatggttgtctgagcagaatgtttttagaagttagatttttttaggggggaaacaggaaccaaagcaaagccaatagagatcttgaaaaaaaaaaaaaaaagaaaaaaccaccgtggtattctaggaagaaaaaagcatttttcgaatgaaaactttttatkatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactscagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccaracctaaaccagtgaattaagagtatggggaagaggagccctcatacagttctgttaaatggtcctttaatattcttcttcagagtgacgggtaccccttgcctatacattttcaaaactacactgaaaatttcaaaacatttctatcagaacacagtcttattctcagctgatctgcaatttccacctggatctgttaaatggcagcttagctatgaaatatcatgttctgcccaatcacctaccctgcctcatatgatcagccggtatatttatgtggacacrtgcagccacacttgtttttaacatttgagaatgacagcgtattggcagttcatataagctatcaaatattacatgtcaactcagaaaacatccctaggaagtattatgggaaccccctgtatcacttgagattcttggatccatatttgctgttaacaaaataaattaatagtcaacaactgattaaagcatttccctgctaccatgattgccttgacaaattctgcagtgctggagtattttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaatattgcaggcagagctggggattccgtggccagagcatatttggtgaaccgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtrtattattctgcaattgctgagtaattgatgatcsttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggccaggctggtctcaagctcctgacctcaggtgatccacctgcctcagtctcccaaagtgctgggattacaggcatgagccatcatgcccagcccccttgtcctcttcttataaggctactaatcccctcatgaggggacccatcctcaagacttcatctaaacctaacaacctctccagggtcccacacccagataccatcccactgatggtcagggctttgacatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctattataacaccatcaaagctgtggttcttaccctcatcattgtttaccctctcacacagtaagatctttctgaaaaggatcaagtctcattctcttttgaaccccaaagtccccagccaccacagagaccaaatacagtaggtaccaatgcatggcaatgcataggaactaggtgtcctaacttggcactgtatctgccaattttttaaaagacaagatgacatcccaaagattggggcatatttaggataatgccccattctgtgagggtggacattatagaggacatcagcagccagccacaggccatctcttggtgccattgggttttgagaccctcagggtgacaccgatttaacatgacaggtcttatgttcttgggtaatgtcaaacaacttcttgaaaatatttgttaaaaaaaacccaaaaacagaaacatatctgactgggcatggtggctcctgcctgtaatcctgacactttgggaggccgaggtggacggatcacctgaggtcaggagttcgagaccagcctggccaacatggcgaaactccttctctactaaaaataaaaaaaaaaaattgccaggcctaggcgcaggcacctgtaatcccagctgctcgggaggctgacgcgcgagaatcacttgaacccaggaggcgaaggttgcagtgagccaagatagtgccactgcactgcagcctgggtgacagaatgagactccatcctcccaccccctaaaaaaaaaatctatccaaaggccttgactaatgcagaatcagcactaatttacaagccccataaactaaagaccccatgtttgtgttataagttttcaaactttttaaatattttcccctgtcttattttctatcatttcacatcttcttaaacacatatatttttaaaagaggttttgactcactggtgaatttgtcttaaaatggaaaaataaaatcaaatataagaattttgttatgaatctttggggaaacacaattagggaatctaccttaataggtaaacccatgtaatttcttatttccgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttaggtcataagtrtttttcatttaattttttttccccttmatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttagcaagcatgtagctgcttgcctgagcaagccattaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttagcaatactgcccaggcacatgggctgtggctcaagttttcagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttcctttttatcctcctggtgaagtatctccttttccctaaaaaactggaaaaaatgcacttttctatattaattcaaatcatattcaaaaaatactatatgttaaaaaatacgatgtttctgtaatccttacatcccctaataaaaccactgtgtgatgaaactaccaagaagcctctcttgaaaaaaaaaaaattaagtgaacctctactttagaatgttggcttttcatatatgtacaaaacaaaagaggttgcagtgatggcgtggataaaggcacctgtgtacttttccaacctatccaatttcaagatgtatcctttgtggattacattggttcttttctatggaatcatgcaccttagacctgggagaaaccagcgtgacatccagggtcaaggttttccaatcaggtattttgggggaaaaagttctgccttcatgtaacaactaatgtgacatggcagtgtataagacattacagccaaggccttctggttgaagttggggaactgtgggcgttgtccccactagtcctgtcatctgcccttgcaaaaccacccttgggctctctcgcgtgcggtctgtgcaccagctacctttgtgctccccacattcttccacctggcctggaagctgaccatagttggctctcttgccctttcttcttctggttggatttagcaatttaattttcaggcttgctccctgcagggtgtcacttcaccaccttcctctgtagaaggtttcgtccaggccgggcacagtggctcacgcctgtaatcccaacacttcgggaggccgaggtgggcagattgtctgaggtcaggagtttgaaaccagcctggccaacatagtgaaaacccatctctactaaaaatacaaaaattaaccaggcatggtggcacacacctgtaatcccagctacttgggaggttgagacaggagatttccttaagcctcggagatggaggttgcagtgagccaagattgtgccactgcactccagcctggctgagagaatgaaactctgtctcgagaaaaaaaaaaaaaaagaaggtttcatacattttagctgacaagggcaggagctgttcctgctgttactaactggagtacattgcatgaaaccttgctgtttccttaaaccctgcaccgacctttacaaacagtgcctttactaaacactttttacgttacccgttttgagtgtaccatctgcctcttgccaggaccctgaccaagaatttgaaatctcagaccatgatgacctccttgcccaatgcgtaagctgtcctccaaaacacacatttatgggggcagagggagtctctctggaaggaaacttcgtctgagccatggctccttttgcttcccctgggttttaatccttccttcccttcctgttcttttaaggaaatctgaaaaggagcaaaagagctttagaactgcaatgcatctgtctgaggccaaggacagttgtacgcagacctctctgccagtgtttcagtgaccctcctcttgctgcttggctgcctatgagtccatgctgacatctggctctgtctgcccaaatataaacttgagagtgacttccaagatatatacagggctcagaggttctctccccaacccattcactggccctgctctctctcgatgttcccaagtctcctgggtgaccttgtgtgtccttcctgggatattgctcaatcaccctagaactgtaaggccaagtggtcatagccagaacatggcagaaacattcctgcttctattctgcttttctagcatggaatcccctctgccttaatgtgaataaatactccccaaaatgaaggcagaatccagtatctgttgtttaaactaaatccctaactggaccccctctgataaaccctctgataaagaattgatgtaaaatttgggacgctggataggaccaggaagccagagaaagagggcacccttttcttttctagcatttgagttcccaaagaagtaaaactctgtgaatgttcacttcattttttcctgatatatcgaggactccagatgtaacctcattgatagtcttggtgtgttcttcagtatttgtgcttttaatagatattgcaagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttgggtactgagttgtaatagtaaatacagatgtagctgtgtcacattaaaagcacaaccaaattgtagtacaatgttcaggacacttttatgtcactttaaaatgtagagtatcatctaaaaatgagcaattgctgtgaagaaactggggttggctctgattttgtggctcagttttttttggtttcttgagaagatcatctttaagtcaaaagttatgcaatgccaagtactcatctgtgtaatctatttcagtttccaaaatttttcatcacctggttacaaacatctgaaggcaagaaatagccaagattccattgcaagtcccagagtaagttattattagacagaaacaaacaagtaaataccttgggcctgagctattgcccaaaccagtcctgacttggcttgggttctgaccaactgtttttgatcccacagtctgaagtacgtttgtggaaatacaaaggtcaaaccttcccctaaccctctgtaatccctggtggagctaaggaatgaaaagttgcttaaacattttcctgttgccagtttttcttaaacattagtgctattcttttttttttttttttttttttttttttttccttcttcaaccctgactctgattcacaaagaatagggaagcttagccaactgcagtttcaaagtattgcttcttaagcctgggccaagtgtgtagacttgatagaattctgattaatgcatcttattacattaattttagaagaaaccagaaggcatttctcctattcctagtgcaggccagcctgccagaagcatttgcctccttaaagagctaatatcttcagctaccaacaatcataaaactgaaagatctatcggaagagttggcttctctggatgtgcataaggcacactgcaaaatagatgtacagcttggctgaactttgcttcaaatttgccaatcaaaattcacgaacccatgccaagttggctacaaaacctctcgcttggagccagcactaattatgtcaacaagtagttcaagtttagcccctgttaagtcctgtactcctgggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttgactcgtgattgggtgggctgccccaggaaggatgtgcccttgcagaaggtagtctctgtgttcaggtactccctggaaaggctaatggctgaaggctacaggttaccctggaagggagacctgggctgcacatcagagcccatctactttccagtgtggacaagttccagctcctgccccagccctgccacaccatcaccctctccagcacacacagcccttctctgttgattagggttggttgagctgttctaccaccttcattgactcaggccttgaagtgcagtagaaagccctaggacaaggcaggcccagttttgaggctgggtgcagaggctcatgcctgtaatcccagcacttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctggtaggtcgaggctgcagtgaactaagatgccacaggactatagcctgggcagttttgagtgctgcctctaccatgtaactagcttgccagtcaagtcattaactattcggggcmttagtttcgtctttyctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcaggcccatagtactcaggtgttcattccacagaaaagcgttcactcttctgcactctttctcagtcagttggccactgctgttcagttcacttcttttggatcttctcagccccatcaggttcccaggtgaaatgagccccggctcagcaggccagttgtcttcagtgacccccagtgaggcagcaggtgggacttgattctggaggcaagactcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcarttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacataagagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttsstgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactctttagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacrtgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggtgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttcyctgtaagtggaagtggtattcattgatcacacactacatgccggacaccaagctattacattttttgaatatgtttcttcyttgcctcttgaggactaaccagccgggtttagattatttcctccccgtgtcgctttcctgcccccacatgttawagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccscatctctactaaaaataaaaawaaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaaaccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctatyggacacatgtcctaataataaacgtgatatmatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcytccccaacctaaggaaactgagacccagagrttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggacaggatgaaggaaagaagcagtrttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttckctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagacaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggccccctgggagtcagagcgttccctccctccttgccactgtaaatgactatttctgtcgtttgcagagtgtccttttctttctcctacagccccatccttaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaacagttatccattgctgcctaacaaattaccccaaaatgtaagcacttagaatctcattgtctttgtgggtcaggaattagggagtggcttagctgggtgattctagctcagggtcttttctgaagttgccagcaagctgttggctggggctgcagtctcagaatccttgactgaaggggaggtttcgtgtccaaggggctcactgatgtggcttttagcaggaggcctcagttcttcaccatgggggcctctctgtacagcttcaggagcagcctcacaatatgtcatctggtctcccacagagtgatgatctcagagagagtgtgaggaagatgtggcatggccttttaagccccattcttagacatcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggttcggctattggcagtggcatggagtgtgggaaaatgcgtccctctctccttcctggattagaaaagtcatcatcctgctagtgtgaatccatgtcctgtggtggccctctcaggagggattgtgattaaagaatggacaacccaagggaatcatgtgtcatggtggagcatacaggccagcaggtgagttggggaggcgcctttacagaggaaaccttgagcttcttctgtgatattcattacagaacttcccccaaagacagatgacatccatttataattatttcaccagtgacttttgagctcatgcagttctatttatttttctctctgaaagtaagaaactttctttaaaggatttctgccatttggacaatgtgctatgtccccattggtgttaatcagttggtgggatatagaaaagcaaagtggccaggctcagccttttctctcgatctttttttttttttttttcctttcttaagaaagggtcttgctcttttgcccaggctgcagtgcagtggtacaatcagagatcmctgcagcctccaactcctaggctcaagcgatcctccagcctctgcctgccaagtatctgggactacaagcatgcactcctgtgcttggttaattttgactatttttttgtagagatggggcttgcttgcttttttctccagtctggtcttgaactcctggcttcaagcagtcctctcacctcattctctcaaagcactgggatgacaagctctttctttataccagtcctcaacttgcactctttcctgcatacagcttgtttctctaatgtggctgttctcatgtttacttaatggcccagccatctcctcctcctcctcctcctcctyctcctgctttctattctccttcctcatcattgtcctcttctgcgagttcagaaaattgggttacaatacctacaacgtgcagtgaggacactcttttatcataaccccagtaggcttatggtgcttgtatctgatttttcatagtctttcgcttgttaatttactgcacatatgttcctttctcttgtgcattactgatgtgtttaagaatcttgaatatctatatggtgcttagagatttcacagcagttgattgaatgctgttacctcagcatcctctgtgaaactgggtatgactacacccattttgctgatgaggaaactgaggcataagaggatccgataaattacccagagtcacacagctcacaagcaagtgcaggcttccagccaaggtttgctggctcatgcgtttcatgccttctctatggtaccatacaggcactttgtctcccagtggaatataagttctttgaggccaaggactgtgtcttaytctgtgttgcatccctttggcttcagcctcattgtcttgagtttattaagcatttggaacatttcagctgaatgastgaatgagtgaatgagtgaagccatcagtcaaatcagaacactgctcacacatgcatcccaagtccagctgtcgaacgtctggaactgagcagtatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcagaatatttaaataaggggttaatttataaagtgagctacgggaaagtttccaggattgtcrtgcgtgtgtctcataaatcggcacaaattgaatctaggtttctaggtttctgtgcccctcagctcctaagtaaaccaaaatttattgagaggtgtataggttgccatccaaagaaacatagtaagtgagaaaagtgtatcctcaggaggtctgtaaacaaggtctgaaggctggcagaaaggaccagggtctgcaatgtagaatccccattgccgatgatcagaaagtacagcgtagtttgttgcagatgaagacagggttccaggaattcttgatctttcttgaacattccactgacttcttaacagaataaagattttgtatattgcagagataatttatagatacaggtacaaaggggatacagacaaagagaaaggctaacttcaggatgttgcgtatgtcaaatcattacattagtttacccagaaccaaaaaaattatgcaatatataaatatgaagctttagtttttcatgattgttcgtaatgacattattatgataatgactgtttgtaataatcatgcgtaccaccttagtctgagcaatcatattagcagttcgtaattattgaagggctgtcaggaaccagacactgtgctgagtgttctacaaactgtatttccagtcttcttttttgttcaatttccactcaaatttttaaaggggtttggagggcgttagtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctacaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggggaaatattccttcaatgttacaagcgcccatgagcatgttagtagagcagttgtgtgttgaagaaagagaaggtggagtgatactgaataccccgtaaaatcacacaatcagcacttaagaatgttcacacagttgttcacaaacatattgatatcagaccttatagcagtcctattggctagatcagttattatgaatgtgttttatagagtaggaaacagagatgcgacgtgacttgcctaagaacacacagcagttctgaaactcaccctgtgctaatctgacctcgtgaagaaattgagcaaactaggctccagggagaaacgaaaacaayaacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatatacygcctggcctcttctttgtaagggtataacagcagtggttaacatgcattttttttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcccctgtggtttggattcctaatcacgggactgagatgaaacagaatctcttagcatagggggccaagcagtagatgggcttttgcgaagaagttttttcttttttcagagtcagaggttggcagcaaaatatgagagatggaaggtcaagtgcagcagaagagagaaacagggagagtggaggttgttctctagaacatagaagccgcttcttcatcccacacaatggaaaccagagcccagattatattaacgagaagttccagaattgcagatggccctttgctgcttagggaggggggagaagaagaaggagaaaaagaagaaaaagaaaaagagcaggtggaaacttaaaaaaatgtttagctgcatgtagatggcttttattataactgctaggctgaaccagaagacttgagctatgtaaaaatgtcacttgctcttatcacggttcatagagattacctttcaacgcgagtttcattttcatttcttccaacacttagagaagtgaacgaggcagtgactcctttattccctaaccctcacccagcaacttgctttttcctctgtgttttgtgtcattctgtgtgatattgcatcaaggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggcacagttagaggccaggaacccatcttggctgtgtgccttctgctttgtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggtcattcccaggaagcaaagcgagcgtcaaaaaaagacagggtagttgggccatggcgttgcagagtgacagtgaaccaggaaccagaagagctgacttcagaggaggctttaggcgctcctgcatgttgattcttagagaactaaagacacagttgcatcttaaaatgttgagacttacacgtatacacaataagaatattttctttggctgcaaatgtactataaaagagtgaaaaagccaatcccaaaagattacattggtaggattccatttacataatgttcttgaaattagaaaattataaaaatagaaaacagatggctgggcacggtggctcactcctgtaatcccagcactttgggaggccaaggcagatgggtcacctgaggtctggagttccagaccagcctgaccaatatwgtgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatwtaaaacagcaactggaggatcctgrtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctctattttgatatattttctcttcctcccttccagtctctctcttctgttcctagatataaaatggagaggttttaaaatgtaattacatctaactatcccctggcttggtaatatccaaccttttcatgtcctcagagaggtccaaaggctttgctgaaacttgttggtttggcattgattttgacaaaagacagcaacaagatcccctttctaggaacccatgtggattactatggattcagaatggatgcattttatgtacagggctgtgactttttctttccccttcctcatgctaataggtgttaatactttgcaataaatattacttatgtctatgaaatgaactgcatcccagcctgtcagcacatatttattttctcattttagtttctccaggttctcactgttatggagggtggggagggggtagaataaggttaggctggagggcatatctgatttggaaaatacatccctggtgatgttcctaccaagtcacaggcttggttggtgatgctaaattgggactgaggaatgggttaggagaaggcttgaagaacccacctcctaaaaccgtctcatcatcgtctagagatatttctccaagtgcttttgtttccagtgacctcccaaccccaggaactagcgaagccttcaggcaggtaagcgcacaaatcctgcattttctagttaaccatatattattagctagtgacttgagcaagttgcttcattttcctgatcctccattcccttttctgagccacagtttcttcgtctttgagtagagttaacaaattactgggtgtttgaaagatcaaatgagttagcacatgagaacatgctttgcacaaacaaagttgtatgcaaaataagttatcattatggcatgggagaaactgtttgtggacattgcctcccagttgaccctcagtgtgtacttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccaccgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattcttacacagtttgtaagtcttaaaactcagtatckactctagtagttgctccaaatgtgatgtcstcataaatcaccgagggatcttgttaaatttggaytctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatttttgtggtctgtgtttcttataaattggtgatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgccwgtttcttccaaaatctggattcagtgacatcgtgttggtagcttgaaactgaccgtggtgagaatatttacaccatggaaaktggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttayacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatcggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaacctgggtgaaaaagtgacaccctgtttcaaaaaagaaaaagaaaacaaaaagttggaaatgagtgggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtcaaccaagatyacgccactgcacaccagccgggggtgacagagtgagaccctatctcaaataaaaataaaaatagaatacaaggggggataaagatagacttaaaatacgctctctagaaaaaagtaagaaatatggaaakaaatctaatttagaaaaatgcacgcacccacagrcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattcttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgcaacaaacccacaaatgaaatgttttgactctttgacacagaatggttggaaatcacttccttggccagagcaggggtccggtgtaaaggaggaaataaaaataaaaaagcataaatgaatgaggaagtgagcaaatcacactcatcgaggagcaaaataattcattccctctccgtggctcagcatggatgcaaataatgtatcattaagtaagtccccaaaacaaagacagccagcataactgttgcatcaaatatttagccagagccaaaagcaatttattatgttttttaaaataagtttgatttactaaccttcagcacaatccctatttttagaggttggctcatatttttaatttgttttctctgaagcgctgcatccttggtagcgtttcagctgtccactcggttcctaatggcagagcaacaccgaaaagcgtaattacatttcctaattatgtgtaattaggcaaaacccagatgatgtattcaacatgctctgagaatagccaggggttaaagactgctggaatttggtaacatttttataaataagctggtgcgttatttaacgtggaggtctaaggtgacgctgggtgccttgtagaccgatactgtggttgaaatctatcgtatttgtttatttagccaagtaaaactgtaagtgattccccacctccataccttcccctcttttggaaaccagagtttagttgtgctattcttagcccaagagaggccctctaaacccagaaccataaagttctgcttactgacagcctaagtgatatttattttttcaaagcttaatccttttgaaacatggagaaataaatacatcctcttatctaccatatgcctgggatgggaaataaattcttattttcctgccgtgtggtaccagtgggttacgatgaataatttgggcagtctcactgaagataatagggaagccttctctattaccagtgataattatgaatctcataatggaaaacatcccgagcccgaacatcaatcagggaagataaacaatgggaaatgataggtgtacaaaagggaaaatggcaacagcacatgtggagggaaagaccgcagaattctggcrgggttataaatcatacagtcaaataatttccgtgcaattaatatcctcaaattaaaacatacgtttttaaagaaagattttgcagacttttaagctgggcaactgtctgccttacaagatgcgtctggaaaccccagygccatcctccttttttagtcttgtatatttatgtatccccggccagagttggctggggcacagtctaacagtgtcaccgtgtaagctgacccagtgaccttgctctagctcaccagggactgagcatacaccaaagtggccagagctagtggttgctgactctcaggatctttggccctgacagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatgagaagttttccattccaaaccctttttaggagcggcctggaaactggagtcaactgtcaaatatgtccttatggccacaaagtatgctcatggattctcttttacaggcttagcataatattttataaaacatatttttaaagaaagtgtaattttcccccaaaagcaagggttttccaatgccatataatttactaagtgtggctttgctgcgtaatagtccataatttatagtcagcctccacaaggcaaaaaataactccaagctatgattaagtaagtaatggacaaggtaactaatatttccggaagaatggccttccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagcttcccctaatactaacatgatacatttttcagcactgagaagttaaccttgttatgatgctattaactacactcagactataactgaccaacagactttatttggatttgacggtgtgtcctcttccttcttttacaaccagataccacctggcatttattatcatatctctccagtcccctctggtctgggacagtttctcatgcattattttttttaatggccttgaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattgggggaggtactttgggactacttctcwaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgtttctttgtttttttctttttgtggagagcagggtcttgctatgttgcccagctcagtctcaaagtcctgggctcaagcgattctcccgcctcagcttccctaagtgttgggattacagacttgagccactgcatctagccacaactgagttcattattctgagctttctttgggatgttatttaactctcagtttcttcttctataagatggaaataataacaactaaaggctaggatttggggaaggtatggtaaattgtaaaaatggtagcttgtttaaaaaaaaaaagaagaagaaaaaggaaaacagtatttccctcaccgcatcaacacctgtcctgtatgactggcattgcccagtggaatcttagcagcagaggcatgacaagcggtcagatactgggactttctgtttcgttgcttacaaccctgtgaccactgcacgaacaaccctgagctgacctgctggagcatggtggccacataaagggagagtggttgccccagctgatagcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatgccatacatgagattcccaaaatagacgggagttacacagagacctttttttttttaacctcctctgagattttttttaacctcctctgagattctgtatttccttaatgasccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaaraaagaaaacaacyacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctgtctctacttaaaatacaaaattagccgggtgtgatggcacaggcctgtaatcccagctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtttcacttaacattatagcacaagtgtcttcccctgttgtaacatagtgattattaatgtcaaatatcagctagataaaagctgtcaagtgatagaaagtccttatagctcataaactcttcaataactgggaatttataccgtttatagtttttttactgctaagaataatgttgcaatgaaacgtttgtatataatgctgtttagtcccctctcccccattgtttacgattccttggagttccactgctacttcatatttaccatcaccatccttgttcaccattgttgaagctttatgtaatgacgagcctcatccaggacctacttgtgtctctgtgccagtcactgcctgtgaaccaggggtgtgtggactcagggctcaattcaaaaaagaacccaatcttattgggacaaacagatattgatacccctggtctttgagccccactgtcttttcacactaatgagttcttagtgtctatttttggtgattgagtagaacttggtgccatattggctcaacatggaagatttctgtgatcacttattgatcagtcatgaataaggaatcgggatggcagtcgggagtgtgccaacacctctctcagtattctgggtctctctgcatgtagtgtttcttttgcagctcctagagataaattttttaatgtattacatgtgagttatttgaaagagggtaggtgtggacagtgaggccaggtgacttaatttccagaagcttgcctgtggtatttaccttgatgagttcattaacaatatggctttcaccctcaaacttgctcattcagaaattagactttgtgagcccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagtttacttataggcagaagtacgggtactgagccaagtgacattgtaagttatttaattggcaaatgattaaagcaaaggtcattgcctatatgactcaaatgcttggttgcctcagaagataatgagcctgatactttcacagtgaagctgtattgcacgtttgtgtttgtttattttccatctttcccactagacggtgagggactttatctgtctcattcaccactttgtccaacctaggacagtgtccgacacatagagatgctcaataaatcttggctgagtcaatacgtttcaaaatacaaggtgactccaaatataaaacaattttttattttcaaatgaagtggacctcccctaaattttgtgcccagtttataaactttaggggctgtagatgaactgttcaaaagttttattgtaggatttcacttgctaatgcattttcacaagtaatgtatttattttaaaagactggagtttttatatatccttacatttatgaaataatttcatttaaacccttcatgcccatcttcagcatcattgctaaagcctcttggtttctgtacctgtaatcttcattcattcctcagctgtttgaaacacagcacttttgggatccttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgctcctgaattcttgacccagaaaatctatgtgagggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaacwgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccaggctggagtgcagtggcgtgatctcggctcactgcaacctctgtctcctgggttcaagcaattcttctgcctcagcctgctgggattacaggcgcatgccacgaagcccgactgatttttgtatttttagtagagacagggttttgccacgttaaccaggctggtattgttttcattattgtggttatcattatttatttagttattgatcatcaaaatccagaaatccagtttcagcaaacattccataacccggtgtgctaaaaccccctcactgctctccattactcatgaatcttcttgaccatgaggcagaatctttgtattttcttctcatcaaggattttatctgaaaaacctgtagtacttcgcctttccctgggtggagaagaggggcggataaatacttctaaagtaatgtagtatgcactctcctgcgtggtgggggtgtagtgggcttcctgttatgaaacccagcttgtaagcatgtatctacatcccagggaggttttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatgttcgattaaaaaatgaacagaggaaatgaaaaataaaattgtctgttgtaccaccacctgaagataaccactactatcattttgctatatttctttctatatttttctcagcatttacacgattgtttttacatagtagtgactttgccgaacagttatttcatttcgcatcttgatattttttctcaattaaaataataattgtgaacattgttctttctactctaactactcaggttgcttataatgagcttgtattataataaaacttcattttattttagataaaatgaaaagatgttactatgcaggtaactttatttattatttgcatgcagtttatcaaatagaattccttggttcagcaaaatgamacctttaagtcttttagcaccaaatgtttgaaattatcatgaaacacattctaatttggcagtgagttcaggagatgaagactgtcctttagttaacatcaatagctttctaaaatatgtagccagttaatattttacttttgcctatgcatccctcaaattgtaacacccctggaacataaaaattcctctattgagattaacacctaacgatacctgtatttgctaatttgtttcttttttttctttgaagcagcatgttgctttgtcacccagactggagtgcagtggcgcgatctcagctgactgcaacctccgcctcccgggttcaagtgattctcctgcctcagcctcccaagtagttgggattacaggcacatgccaccactcccggctactttttgtatttttagtaaagatggggtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattatwacctttgttyttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccaaagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggatgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcycttgarcccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgccaccatcatagagtatacctatacaatcctagatggtataacctgccatactcctaggctaggtagagcatattgctccctggcagcaaacatgtacagcatgtttctgtcctgaatactgtaggcaattttaatacaatgctaagtatttgcatwtacaaacatagaaaaggtacagttaaaatatggtattacaatcttctgggatcaccattgcatatgtggttcattgttgatcaaaatgtcattatgcagtgtgtgacagtgcttaaataatttatctcacatatgcaaagagttttggctaagggaaaagaaaaatgtgaacctcctaatagaaaaatgggcaaagataatgaacaagaaattcactgaaaagaattggcaaacatgaaaaaattctcaactttatttttaatcataaaaatggaaattgaacaatgagatactgtttttcaccatgacattggcaaaagttaagaaggcagataacttccatgttggtgagcatgtaagtataaaaaggtataaaaaagaagagttgtcctgaatctggtctggaatagaacctttttttccatgatgcatgatgtaattcacagcctcattcctgataaattgcttaagcaattttctgataaactttaatgcgattaagacttgttctgagaaatcagtcacccatctacccaagctgactgtcggtcaagagtctagtgaccttaaaccaaatgttattttccttttgtatctagcctaacattgactatcttgtcatttcattttcctataaaatgcctccaccaaggctgaatctttgaattgatcactasaggccttttccctagtagtaacattataataaaactttgactcatgctcataactcgattttccaaaaagttttcctttacaggagaaaagaacagctgctgtttataggagcatacattgtttttggttattttgaagaacaagttggcatttttgaccgaaattaaacacatgccttttgatcaagcaattccattctgtaccagaaaatacagaaatatttgaatgaatgtgccaggacacccaattagaagaatgaatgcttttttagcattattttgtgtgcatacatatttatttagttatttgacctattacattctaaattgatattaataaagaggtatttgagttacagtttttccaaagttttaaatactctatagcaaaaaaaggaaaaatgaaagaaattaaaaagatacctctatatacatacattgtgtgtttgtgtgtgtgtgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtggatgtatatatatgtgtgtgtatgtatatatatgtatgtatctgtatatgtataatggctgkmcatgatataattttgagttggaaaaagcaaattgaagaataatacatgtattatcatgtctttaaaaaaaaactatacacatagctgaatgtttttgtgtgtattttcataaaatgatttggggttgaggtgataaacattaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtcttacttcatcacccattctgtagtgcagggcacaatcacagctcactgcagcctcaaacttctaggcttaagtgattctcccatctcagcctcctcagttgctgggaccactggcatgtgtcaccacatctggctaattttttgaacttttttgtagttggggtctcaccatgttgcccaggctggtcttgaactcctgggctcaagttaccctcccacctcagcctcccaaagtgctgggattacaggtgtgagccaccacggctggccaatatctactagttttgaaattaaaaaaaaaaaaaaaaaaaaatatatatatatatatatatatatatatatgaaaaaaaggacaaacgatttcagttgcacaactataatcgatgaagtggctccttgatgttctcggggcaatctgagacactggggagaaccctccacctttgcagagaagcaggatgaaggggcctaaaatgagttcaactgatttcaactttgtttcccagcataaagcttgggctgagctgcctgaaagggaagtggagaaggcaggaatggaattgatttttcccccctgctgaattccccttctccctactcccttcctgcaatttctaataaattagaagagctctgccttccagaaaagagcagaggtaccttgcagtacttttgggaatcttaccaggaagaactgggtctactattgcaaaggaaaagctttttttacagtgttaaaaattaattaaaaatggaatgtgttatagctcgatttttatcattagcacccattccagagggcatgttgctgttagtaaaacttcagatttttcctgtcattatggatttggttttagggaaaataccttcatgttcagcattttatgtgtcagtccctaaaactcatgatcttctgtgattctcttggtttaagagcagggcgagtaatgtactcaaaaatttctccatagccttctgggttagaggatataacagctggcaaacagaacactaatagctattgatggttattttcaaaggatggacatcgatagttaagttttaaggaagaaaatgaagaggaaatttaatgtgatttaacagtgatttttttttaaagacattatttgcatctcctattttcacttacttataaacaggtggtttccaagtagacatattttttgcttgcttgaatgagaaagcataatgaactttgtgatttggtgacatatccagatagctatagcaaatagctataatgccttagataaatagcattttcacgagtaaactttttagttctcaaaagaaaaattgtaacaattttctagccgcatattagcattatgcacaaacacataaacttttggctggaattgtggaatatgaagtagctcccatccttattccatcgcccatatgctaaaatgtagattgtattagttgagaaattttaccaaatatttacttatactgtgctattatttatactatttgtcaattccactatagtagatgcttaataaatatttgtgaatcagtaaatggatggatgaatgaatagtggcctacttctgtgaaggtaattgaagaattcccacacttggccccctttggatataacgtctgttctgagcacctcccattcactatcttgatgcctcacataagacctagtatatagtaggcagtcaatgaagatcacaatgaattggctagactttgatttattcatttatgcaaattgcctgacattcaaagaaaaaagaaggaaaaaatggacctcttatcatgtgccagacattgttctaagagggaaagatactgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacaggcgcatgccgtaactcgcaactaattttttgtatttttttttgtagagatggggttttgccatgtttcctaggcttgtctcgaactcctgggctcaagcaatgtgcttgccttggcctcccaaagtgttgggattataggtgtgagccactgtgcacagcctcagaggtcctgtctgcctgcctgcctttcctccctctctctctttcttcctctctttgcttctttccttttttccttctctgttgaaggcctgaataaaataaaagactgagtaagaaagaattgactccctctgcctgacttcaagctgggacgtaagtcttctcccagtccatgcatccatccatccacctatccacctattaacttattcacactggctttaaaattatttttggctccagcttattattttaaaatgtaaaatgatttacagaagttgacagagagtataattaaatcccatgagtctaccatccagattcagtaattattacatgtggccattgttgttttatctctctccacccacttcccccatgcctgaaaatttaccaaagtaaacgcaagacattatatattgttattcatagacattttgagtaactaaaagtaaggtctctttaaaaaatgataattacagtatcatcatcacacccaaaaacatcacaaattatttaatatcatgaagtgaaggcccatttttccaatcattctctaaatattataaatgtcatctttcattagtttgtttgaattccaggtaaaaacctttaactcatttccttcttttgatttttcaaaagttggttgaatagtttctgtcttaaaaagtccagaaattgttgaaataggtaaagcacaaaagaaattaaatacaccatgtttccaggcctctaatgttttctattcaaggttgtaatatccagtgcaaggctaaaattgctttctggtgataaacatttgagaaagatttggttgttggtgatactgatggttgtagtaggagtctctggagaaattgaactaatactatatgtgtgtgtgtatctatgtatagatatagatacacacatgtatctattatatatatagagagagatatatgcatatctatacacacctacgggtgtgtctgtatctatacacacacctatgggtgtgtctatctatatctatacacacctatgggtgtgtctgtctgtatctatacacaccgatgggtgtgtctgtctgtatctttacacacctatgggtgtgtctgtctgtatctatacacacctatgggtgtgtctgtctgtacctatacacacctatgggtgtgtstttctgtatctatacacacctatgggtgtgtctttctatatctatacattatatgtactaaataatatatataaacactatagtatatagagtatacatatacacactatagtgtatgtactatacactgtgtactaatacagtgtataatgtatatatatagtattcaatatagatctataaacacacaagtgcatacacacacacatttttctgtatatatgtataaagatatatataaagatttttaaataaggaattgactcatgaaattacagagactgagacatcgaaacccaggacaaccaatggtacagttcatgtctgagtctgagcagctgagaagcaggagataaaaaggcatcagttccattccatatccaagtctgagtccaagggcaggagaagctgatgtctcagcttgaagtcaggcatagagaggcarttctttctcactcagccttttattttattcaggccttcaacagattgtatgaagccacccacaytgggaagggcagtctgctttactcatagtactaatcgaaacgttaatgtcctccagaaacgccttcatggacacactagagataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcagcctcccaagtaggtgggattacaggcgccaccaccaagcctggctaatttttgtatttttaatagagatggggtttcaccatgttggccagactggtctcaaactcctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaycaatggaccactggtcyctgctgatttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctrttgtacaatatatggtcttttgtgattggcctcctccacttagcrtcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagacagaatcttgctctgttgcccaggctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttggtaattaaaaacagagctgtgtggctatttttctccaactcctttttttttttttttttttttttttttgagacagtctcactctattgcccaggctggagtgcagtggtgtgaactcggctcactgcaacatccacctcccgggttcaagcgattctcctgcttcagccccccgagtagctgggaccacaggcgtgcaccaccacacctggctaatttttgtatttttagtagagttggggttttaccatgttggccaggctggtcttgaactcctgacctcaagtgatccacccatcttggcctcccaaagtgctgggattacaggcgtgagccaccgcgcctggctttcaaattccattttttaaagttaatgctttaatatgttaaacacccttattaacatattacatatgttaatatgtaaaataaactccgtacattttaaagtgctaaaggttgtatgtttgtgcgatggatatgtttaagagaatgatttaggatgcgatcagttttttttccttgacttactctcttcctttatttttttcccttcttcactttctctgttattccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctctttctcttccttgctgaggcttttgacaatttcaaatgctccctgaacctcagtttcctttgccacaaaatagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttgrttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaaccaggaatgcactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggttaatgatgagaaggggtgggtcaatgacaagaaaagtggagaagatgagacagacaaaactgcaactcatcttcatggcacactggtgagtgggggagtgcaagaagtttaggtgcaaaggaaaatggagtgaacatcttggcttggttaacagaagaaaagaataccaacgccgtctattttcatatccctttctattttatgtacatatttatcaatatactttttgttccagaaataaatgggaacttaggcacaatcttttacacatcttacctcaactggtgactcttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgyggaactaatttttatactgccaatctgaggccttttctgacctcatcgctgccactgtaaaatgarttctagccccagaccatgacatgcctactagcttagctctaaccaaaaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgcttatacaaagtcttgttcatgaatgttcatagcagcatcatccatgatagccaaacgccggaaatacccaaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcaaataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccgagagttggttstgattatcttcagtcagaaagtgcctacttttccaagcatccagactgcaacctgtytttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcycscagatagcctcttagcagagycaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagsgggaaattgctttccrtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattrtaggcatgagccaccatgcccggcctaatctaatcarttcctttaaatctgaaactgtcygcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacagaaagaggggggatttttccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggagccagttcacgcttggatgactctggagctgtggtgacaatctaaatcctaaattgaggcttactaggaaatgcactaggtracaggctctagagaaatggctattaccaggttgctcaggctggagtgcagtagtgcaatctcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggawttataaaggaattctggttataattgcakgtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagttaaaggaaagaaatgccaggctgagagatgagacagtgaattacagtgggggataaaggggctgtggtgtcacacaggcctggcatctgtggccttgaacaagtgcattaatcactctaagcctcaatttctttgttttaaaaataattaactaaaataccttagggcacatggtaggaattcagtaaatgctcactgtctttctcatccttttgcttacctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggctggagtgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaactcagctgggcatgatgttgcatgcctgtcatcccagctacttgggagactgaggaggacgattgcttgaggccggaagttcaaggctgcagagagctgttattgtaccactgtactccagcctgggcaacagagagaccctgcctcaaaaagtaaataaaatagtaaaataaaacgagatatttggaaggctatgtttttttgccaggccatgtgcttagtccctgggagtatagcgaggggcaatcacaggtcaggtcctagtgtctctgaagacttcattctagtggccattgaaaatgtgtaactacccacagtaatcaagttaaagaaaggttctggctgagcacggtggctcatgcctgtaatcccagcactttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccgctgcactctagcatgggcgacagagcgagactctgtctcaaaaaaaaaaaaaaaagcttccatttgagccgccaggaaaggaggccctgagttggggagttgaatagagagctgcatcctgaacagacatgatcttgggtgagtgagaggctaggagcggagggaaagcagacgcagttgctaaagctgtcaagtcccgctcccttggaatgcagtcctggttctgctacctccaactgggtcgatttcaaaaaattatggacttgtctgagcctgatgtggtgcctggccagggctcactgcagcgcctggtatacaggaagaacttgatgttattcatggcaaaagatgtctggatggtctccactacagattctgatggcaagtgacttaaagacatgttggcaatgggtagtggacaaaaattgaaacaccttcaactgtgtctgtgaccagaagatttttttctttttttttttttttttttttttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagagctccccttcaagcatagagacacaaccctgtgaaaacatgcattggaaccaggaaggcctgcccccatgacttcacgttgcatacatgcctttgaggacttggcctcttaaaggaatctttcaatatcctatgcttctgagaaagttactatttcatttgcagcaggacaactcaacaagctagctcttcctgcccagcagactcggtggattctgaagagggtctcgggctgactctctacttcatgggtttgaattcaggaatgttgcaagattgcatgagattaagccgctgaaacctttctgaggaagagccagctcaaatttcagtgttggatgttcaccgcttctttagggttctaccactcccagtaaatcaagtaataggtttctgttaaaaaccccagtgtgctgatctcagtggcrgccatcttgctttgtaagccttctctagctttatgatgctcccagtatataagacatttccagtgtctagtccaaattagtatttctctaattctcgagtgtctgatctgcctggctagaatgattaaaacaaaaaaayagcaaatcagtttgacagtccacttcattaagtggaggacagtgttttgattgctatttaatctgtttttccttctgtctgttcttggctatatggaattcactttgcctctsttcccgactcttcatatcccttatctcaaggtgagtatcgtcagaatcccggtacatttcaccagccaccttttatagaagcttagaaagatggaggcaaacccataaacaagacttggtttttctaagccacagtggcaatttcctagtcgattacaactgtgtctaccctttcaactggcctgtcagtgtaggctctgcatgtcctggataatcctacaattggtgacacggttattgacttacaggtttctagggcatctcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctrgatatttcaactagtttacatgactttcttacctaygctaccttataatccttttataaattttgctttacgttttaacaacggaaaacacttaaggtttttttcctttcttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccragactctgttatgacagaaactcaccagttctctgttgttaatcaacaaatagattgtgaatgcttgactcttctctttttttttttttaaaggagtttcaagggtaagatctgctgtcttgtgaatgtcaaagaagtttctcattcgcccctttcttctctctcccastgtctttaatttgttaatgctttcgacttaytttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgccttaaacacctcatctattatgctgtgctcaaacagatattttcatcttaacagcttggcaaacccagtggaacgctctttctagtttggggcataaaataagataacactctgaattcctacaggaaatcttgtaactctacttaaaattaaggcataaagyaggaaaatgtgtttcctctgtatagtcttattactttgcctgttaagttaactggttcctatttctgctggttygaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcktcacagtaggacaccaaaccctctgtatgccctgcctgcctccccccctctgacccgcctgcctccccvctgtgagctttttccacctactggcctcttgttcttcttcagctgttcctcagacatgccaggtgtgttcctgtctcagacgctttgcctttgctgctccttctgcctggagtattcttccaygtagcaccaygagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtataatgtccaactcactctaccacacagcaacataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctsagtaagtatccactggggttsggaatacaactgccctgcctcttgagcagccatgcctgcttccgaggtggtgctgmatgctattcaggaggacagaccatggatggraatcctgagccasaactccttagcctcatgacrttgggcagatgactgagcttgtctgagttacaataaayaaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatgrtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagagsaagtgaagattgcatctcagtatgagacaccgtaagagcttgataaatggtggaccctctgatgttgacaacatgatgtcaaagatggtgtttgctgttgtttcaaatgtcttatttcaaattcccaattagtttcttcatgccataaggrcaaaatccacatctcatactttttcaggatctgctctcacttccccaaacatgtaataccaccctggtcttmaagtccactctcaaaaaaaaaaaaaaatttggcctttggcctcgtgaccaccaaatctgatttccatccaagargcaacattgtttgtgcttagaaggaattcctggctgggcatgatggttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacamcagtaccaaacgaagatatctttgctgtatttgcagttttctctcttattaacatgaaaacaccttacatagatggaaacatctaaaggctattttttattttattttccattacttcactctaatgctttcacccgtacctgtggaaattagactgtcacctgcttttagcatcctgttttctttcgtgtttgtaatgaagccctccgggaattatgcgattacaaaaatgagttacaaatcctcattcggtatacgaaagtatatagctgctttccttctctgtttaaatagtctacaaaacaagaaataattagtcaagcactatcggtaattaagcacataagatgaacattaaacaaactgcaatcttgcatcattttgaaggtagataggcaggtttttgcatttggaatccagccaaaatgcccatcttcattccctttgctccttatttattattggtgagggaattcacttgccgaacttgctgatgtactcttgctggcggtccatctgagagttcacataagtgtgagtgactattttttgacaacactacctttgggagaagatggtttcaaagaactwactgtatcaaatggaaagacaatgtgttttcccaacatgggagtatgtttctaagttgggatcagttcacgattcagagaaatgctctgccttcttgtctatgatatcagatcaggtcagacgtaggtataagaccctgactcctgttttccaagcacttttttttttcattatgagtctatctttcggtcccctaaagcttctggtaattttttttctttttttttttttttttgagacaaagtctcgccctgttgccaggctggagtgtggtggcaggatcacggctcactgcaacctttgcctcctgggcgcaagtgatcctcctacctcagcctcccaagggagctgggaccacaggggcacaccaccatgcctgcctaatttttgttgttgttgtattttttggtacagatgggattttgccatgttgcccaggctggtctcaaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacgccaaaatggttcttctgctcagttggtttctatagtgattttatggatataggcattttcttctcgaattagaagaactgacagtccaggcacggtggctcatgcctgtaatcccagcactttggtaggccgaggtaggtggatcacttgaggtcaggagtttgagataatcctggccaacatggtgaaacctcatctttactactaaaaatacaaaaattaggtgggtgtggtggcgcatgcctgtaatcccagctactctgaaggctgaggcaggataattgcttgagcccgggagacggaggttgcagcgagccgagatcacaccactacattccagcctgggtgacagagcaagagtccatttacaaaacaaaaacaaagaactgacaataaatagttttctccgttttgtgacttatttttaattattaagaataagtgtcataaagccaatactttctaacatgtgtatagtatgttatagttttcaaagtctttgacaattatacctagggagccaggacagtatttgtatcatcatttcattgttcctggaaaacaggttcagagaagttaagcgacttgcccaaaatagcacagcaatctgacagagccaggattatcttccatcctctattttattacctgtgcctcccattaaatcatcctaagctccactacagctggagaaggttctgttaacacaccatacatcttttttttttttttaattgagatggggtctcactctgtcacccaggctggcgtgcattggtgggatctcagctcactgcaccctccttctcccaggttcaagtgatcctctctcctcgcctcccgagtagcgtagctgggattacaggtatgtgctaccgtgcccagctaacttttgtatttttagtagagacaggggtttcaccttgctggccaggctggccttgtatttctgacctcaagtgatccacccgcttcagcctcttaaaattctgggattacaggcatgagccaccgcacccggttatacatcttaaatataaagtttttacaatgccaccatttaaaaaaaaaaaaaaagggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagttcgagaccagcctggcgaacatggcaaaaccccatctctactaaaaatacaaaaattacctgagtgtggtggtgcccacctgtaatcccagctactcaggaggctgaagcaggagaattgcttgaatccaggagatggaggttgcagtgagttgagatcatgctactgtactccagcctgggcaacagagcaagactctgtctcaaaaaaaaaaaagaaaaaaaaagtaatgcaataagcgtaccatggtcatgtgagatgttgacattaggggaaagacaataaacagcgtggaggaactctgtgtactctgtttgtaagtttcctgtaatactaatattctaaactaaaaagataatttaaagggaaagaaaacctctttatgatagtaacatcagttggtataaccattttggaagacttgatttacataggatcaaatataagtatatctgatcccctagaaatttcacttctggccaggcgtggtggctcatgcctgtaattccagcactttgggaggccgaggcaggcagattgcttgagcccgggagttcaagaccagctgggccaacatggtgaaaccctgtctctacaaaaatattagtcaggcatagtggcgtatgcctgtagtcctagttactcgggaggctgaagcaggaggatcacctgagcccagggaggtcaaggctacagtgagctgtgattaggtccctgcactccagcttgggtgacagagtgagaccctgtctccaaaaaaaaaaaaaaaaaaaacaaaagaccatttttaagactatgactggtcaaaatgtgctcatacatttgccaaaagacaagtacaagagtgtgtttagcagcattattcattataacacactgaatcattattcatgattactcaagacatctggtaaaccacccagatatctatcagtggtggaatggataaataagttgtaataaatccacacaagaggagactactcaccaacaagaatgaatgacttagaactaaattcaacaatgtggatttatcttacagagatgatgttgagagaaaggaggaagatacagaggaatgtatcctatgtgattatagttacaatgagttcactaaaaagcaaactattcctattagaagtcagggtagaggatggatgggagcatgaagtgtcctccgtcatgttgctaatgttctgttgcttgttcaagctactgggtgtgttcagtttatgaaaattcatttartgacacatgtatgttttgtgaatttttttgcatgtatattttactctaacaaaaagttcatggacaaatacaaaatcatatctgacagttgttgagagaattaaaggaaataataataatataaagcacaatcaatgcattccatttattcttctgcttttcccatcaattcatgttacccagtcattaatgcataccctctgagaccccaccaagccatctagccctcagctgtgtcactgggcagttgtttcttccactgtgcagtgtttcgttcttaaccaacatggcaccccaggttcagtggtgagagtgtcactggcaacttctgaaataacatctctgttagtttgtggagtgggctaaatggccagcccttctacgagctccctcatggttgcgggggactaccaatcactctctactttttttttttttttttaataggtcttgtcatttgtaaatgcagaaggaacactgaaaaaaaaaatactcttgccttcttccatctgtattttctttactaaattatccagtcttataaatatttgaataacatttggtcagtataaaatctttcctgtcagctcagtacaagaacactttttggctcctgagaccacaacagtcagataaattaatattgatttgttagaaaatagttttcactctgtctaaacatcttattctgggctcttgaaccaaaattatgaatttaaaagcagcaaaatagttcttcacagttttcccagtgaaactaattatgggcagattgtgagaaatgtgttggatgtgatttccaacatagagttctgctaaccaaaattcagagaaactagagcctcagtctctgatttatttgagcaagttgcaatttggtagactggagaatttatgtaaatagtttttgcagtttccatagggataactcaatacattaatatctcacgaatggcagaagatgaagggggaaagttttttttttaactgatagtttgatttacctaatagaaggatcggattcttcccccttcttacttaagtctatatattaaagaacagctggcttacctgctgtataaatatgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttaaagtatacccatacccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattacaaagaaaaacatatatatatatatatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcgtattgtcagtctcaaaccttttctgaaattggaagtgatgaagtgacagtctggctatatgtgtgtgtgtgtggtgtgtgtgtgtgtgtgtgtgtgtgtgtgtgtgtgtgtgtgtgtgtgtgtgtgtgtgtatacctagtctagggctaggtttgggaactattttctcccgtaagttaaactgaactagactgtatgtcaaaaaagagtctcaatgtcaacttaatccattgtcatgactgtaaaatgctatttcattataccagcaattcccctgtggatttctcctgactctctatgcagcccaactctattttaatctgttgtagcttttctttcccctctctcccaactccccacgttttggaattattcagtgcattcgcttccaaggcacctgtttgatatttacacaaattatgaaagtaaggtgggaaggcaatgaaggcaacaaagtatataaaacacacacacacacacacacacacacacacacacacacacacacacacacaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaaagatagtggttttccagatgtgacaaaacaaaagaagatttccaaatcaaaattcccatttgcctttcgggatgttgaattttctccacatttgtgcaattaagagttttgctgagtgagcttaggactctgtctctttaagtgtttaacagtaattggttcatgtcctggtgttcattgaaaatcctagacatttcatgtaaaatcttcttaatgaggggatgaatttttcattcacattagaaagctcactctgacaaacaatttctaaataaaactttggcgacatgacatcccacattggacttgtcagagaggacaggtgcattagaatataactgtatggcgatccttcaagctgtcagccatgaatattttatttcttaatgaatcatctttgtgaaatcaactttcttgttgtagtgtcagtgccatttacaacaaaaagctggctccttttaaaaggtgagctccttaaagatgctgattcctgcataaaatgtttaaccctacccaaggtgttgggcaactgggggctttgtgctttgcttctcccttctgaaagtgacttgagaacccactttgggctagtgtgattacagtgaggagaaagctttccttgatttgttgtttccttctcagaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgtagaatcgctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaataataagatgataaggattcgtaccagggattggcaaatgacagtcattttctgtttccttaagtaaaattttattaaaatacagctccactcattcatttatatattgttcatatctaattattttcacactgcaatggtgcatagtcaaatgctttctatctggctttttaagaagatctttgtccctcccccaccccccgccccgatttatactatggatcagcagcctaaaccctgcaaactgggtcccccatctaagagtctgcagtgaaacgcgagccgacttgatgtgtctcagagtgatcattcttgcccttggcggttgatgctagactgttgcagcttcaaatataatgtattttagtgctatacgacagccataagtattggcctgtgtccactggtctccactaggagaaaaccgagccaagcttgaaagtactaagcgtgcccaggggaaatggaataagctagaaatttgttgtttccttttcactaggtttaagtgagaatatttgtgagcaaactctcagtgtgggcaggtgacaatttctgcaggtattttccccccattttaacttgtgcgatatagttccctattttgttttgttccgcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctckctaaacattgtcacttgccaaascatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgwgatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgayagcaggaagcccagcttctctggtagcagagcaggggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcacagagtcaggcctcgaaaaataccagtcctttcgcctgtcccctctcacatggtttgaatccaagaggctgtcataccaggctcccccattcagtatattttctttatgtttaaatagtttggattgacttctcttttcttttatttttctgttgctacttaggaaaccatctccaggctagaacaagtgcctgaaatagagaagggtgaggtcactgcctaagacacttcctcctccacccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcamactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattattattattattagagacagggtcttgctttcttgcccaggaaggagtgcaatagtgtagtcatggctcactgcagccttgacctcctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttgtgtgtgtctcaaggtggagagaggctgtggaaacaatagagagaatagcatggaaggccacgttgcaattaaacaagattgggaaagaagacgggactaaaatcatgccttgaagatgtttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtarrtttgcttagtcattttcagagacaaaaatttgggaaaaggattgtagaatsactggcttcccaaaaccacttggtgtttacaaagttatcaaaaacgggctgggaccactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtaaacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaaacccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccycgctagaagtgtgtaagagtttatgttgcttcacakcctcatcagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtatcttttgaaaagcagaagttataaatactgatagtgtccaatttatctttttcatttgtttagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttrtactccattgatctaattttttttcttatacttacygctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctgttgatcaatttgaggaggatcaaaatcctgaaagtgttgagcgttaccatccatgagcatgcatctctccatttatttaaggcttstttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttgagacagacatmattgctttattcaggacttctctattatatgtgatsctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaaygggaacattggccrcatcygccattgtcaattttaaataaaagatatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctctttttttcctgttcttttccctctccccacaaccacttctstttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgccatggtctcccaaagtgctgggattacaggcgtgagccactgcgcctagcgaggtagtcagtgttctaaacactggtgtacaatccaagtctgtcgctgcccaggatagaggagggatgacgtgaattcacacgggcctctcctacaaatctgagtgtacatcaagtgaggggcgtccctccgcacctcactgttgggctgatcaatcccattcccactccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaasgcttttaccatggsyaaaccattaggccggctctgcagggagggcaagaccacagcagctcagtatttcctgctcagggaaaaaggccaggtcttttgttggtggaaatscacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagaggtttcccattggccacttggggtacaccccttataaatgaagtggtggcctgcaatcagtcttattggttgcagaaagcaaccratcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtgaagttacaaagttacactcctatgcaaacgtctgattggttgcaaaaagcaaaaccactcagaggtactttcaatttcccatctgccctgcagaaaaggtaaggggttgcaaaagagtagcccctcctccttttgttacttaggcgtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggatggggagcaggtaattatgctgggacaataggcgtatgtcaagatatctggtcaccctatctatgatctgtcacacttagtactttctaaaattctcgggcctttgcaccttctttttatcaacgcttagttctatgttactgaatatttcttaattaagtgcaggaaagaaaataaccaytttttctccttttaaagaagcacacacacctttcttttattggtattacattccttttccctgttggtgcccctgttggttttccaaattgtcttcccatccttgtcctacctcccaatagagtacctcatcctatagtgttattataactacagaaaatatattttcattccttccacttcatgctttcagctagaaatgtgagtctctgagacttgtattcttggggtcacttaaaacataytgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtgcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaagtgctgggattagatgcatgagccacctggcccagccagaatccttccattaataaaaggatggaccatgaactcccttttatgatatgagccgatcaaatgtgagcagaatagtatcctatttatacaatgtagtttaaaaccaacttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgacgcatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaataatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagcccsgcaaagacgagggagcagcaagttccaaagcccrtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccctatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgaggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagagtgaaactctgtctcggaaaaaaaaaaaaagagtttaattcatgcagagctggctgtgtgggagaccagagttttattattactcaaataagtctcccccaaaactcagggatagagatttttaaggagaatttagtgagaagggggtcagggaatggggagtattgattggtcaggtttragatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaataacagccagtcgttcatgtttccttgtgccacgtgattattttgtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcrtcaacttagtccaaawgtagagggtcaggaaaacaatgatatgagaraagggccggttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgctttctcctgacatcatgatcatggactcacatgacaaaatggatcctccatcttccagcatctctgattgagactaacaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgtttttttttttttttaaattaaggatgctgtatgagtcttttctcatactactgagaaagacatacccaagactgagtaatttataaaggaaagaggtttaatggactcacaattccacatggcggtggaggtgtcaccattatggcagaaggcaaacaaggagcaaagtcacatcttacatggtggcaggcaagagaacttgtgcaggggaactcccctttataaaaccatcagatctcgtgggacttactcactatcacagaaacaacatggcaaagacccatccccatgattcagttacctctcaccgggtccctcccatgacgtgggaattatgggagctataattcaagatgagatttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaattaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttaytrggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctntgcgcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggattatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccatacgcaagctggatagagccagggtccctgagttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgccggtgagtgaatgagggagtgaatgaatgagggatttgcagcttgaacgctgtactttgaaacagttccagattcatgaaatttctttttaatgcagaagatttcttatgtgattaactgaatgggaattgatgctttgtggaatgaaatggattgagtacagagtgtgggatcaagaacttttaggcactgtgagtataagagggaaaccaggccgggagcagcggctcacacctgtaatcccagcactttgggaggcggaggcgggcagatcacgaggtcaggagatccagactatcctggctaacacggtgaaaccccgtctctactaaaaatacaaaaaattaactgggcatgctggcaggcgcctgtagtcccagctactctggaggctgaggcaggagaatggcgtgaacccaggaggcggagcttgcagtgagccaggatcgcgccactgcactcccgcccgggtgacagagcgagactccgcctcagaaaaaaaaaaaaaaaaaaaaaaaggaaccagatggccctgcccttgagcaggctgtggtctggcctggtggagagacagagaatcagttaattccagggtcatgtattaggtagtaagatagtggttcacaccaaaaacatagaaaatgatcacttagcctgatccagaagttcaggaaagggctctgagcaggagatggaagacctcttggctggttaaatggagatcaagtggcagcttggactcctgctgcaattaaaaaattactctccagttttcttcatgtgcctccccattcactccaccaccactcaccccaaatcagatcatgattcatttgggttgtaccgattaagagggttccctttacatgaccattccagtcatgaaacagagaatctggtcacctgtcctttatcttggctggtccaattccataagaagtaaatgctgtgtgtctgcaattcaaaagacccctttcacgggaggctgggagatttttcyatctaaatagcttaattgttactctacagggcaatcataaatgtaaatcgacttaatatgacttgattgttagtaatgactgtgcctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccatttwaaaaaaaaaattgcaccrgttctcatcccatcatctgccttgatcaaacatttgcttattggaatcacttcgaaaaggaacttggtatcgttcacatgtgtttataactctcaaatcttcttcttccaatttttaatcttsatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgttatcattgtgtttacagaggtggtcagattcccakcacagtgtactcccgcacagataaccgtcccatcttgataaaacaatgctctcagccgaatcctaaacacgctgcacaaggaagaccttatgctgacagtagggaggaagcgacatgttaacaaacaagtttgccggccaggaagttttaatcagccctttctactgcagggggtatgatggatggagaccctgtttcagaggggtttcctttagataaaacaataataccatgctttcaagaagctcgttcgacagctgtaaagctatgattaatcccccaaaagtcaaacatgggaagactggcaagatgagattattcactgggtataattagccacaattatcgctaaagagaatttggggagattctgctctaaagggaaaagctttgtaaaggagaattaccagtagagtgaccttataatttaccatccaatggattttgaatacttytgagagagaaatgagatactgataataattataccaagacaacagacataaattgggattggcctagacgagcaaagatgaatggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactrcagacctcccaaagctcacgaactgagagtcaggaggcgtggttcccctaactcaaatcagaatttcgttatcaaaagaagagagggatggttctgtggtgtcccacactcaaataaacatcctttaaatacctctagatgcttataattcctgttgcagccttagtcagtgggagccactgasctgcattcgtgtaggaactgagcaaggttcatctagtctcggtagctasctaccccgagagctggctgatttttttttycttaaatttaattcaagacttcatgaagtcaacaaaatggtctgttggaaattattcctaacccccaaccactgtcactgccacaatcaaacatattttcattcttttgcagctgcagcccttctacttgaactttcccactcattgcccttataacttgccatttaatatctcttgctttcctacatggctgtgactactcgtgggcagggactgtatctcctgtttttggtagtgcctccagaaccaaacaccatatgtcataaggtctattaataaatatctgctagtttttaaagtttgagaaaaacccgtattgtggaatgaaaatgatactgacaagggaatacatctagatcagaaatactgatatcstaagtgagatcttgttttttaaaacaaaaaaaagtttaagaaattgtcatataggctgggcgtggtggctcacacacataatcttagcactttgggaagttgagkcaggagggccacttgaggccaggagtttgaaaccagactgggcaacacagtgagaccccacctctacaaaatattttaaaattagccaggcgtggtggtgcatgcttgtagtcccagctactcaggaggctgaggtgggaggataggaggctgaggtgggaggatcacttgagcccaggaggttgaggctgcagtgagctgtgattgcaccagcctgggtgacaaagtgagaccttgtctcaaagataaaagaaagaaagaaagccctatcaaaattttaaaaaataaaacataagaaaaaaataaatggatacatgatatttgtacttctaagaggcatcttctatacatttcctgtttctctcttccttttcctaaggagtccttgttgatttgtggccatgaaacctctctcctttccaggctggcttcttacctaggtcgtgtcctatccctttattttctggcagggctggactgtcacttggttgttctcggtttcaggacccacgtcttttgtctctgtaatgaatgtgttcagaggtctctgcacagagaagctggctgttaggaaaactatttcttctttccgagacaggctgcaaaatgcttgttactattttgtgtattcctggcaggatttgtattcttagttttattactaatgataataacagttaatgttgaaatcagcttcatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagastaccttyctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagagacacccccccactcttagcccacttttatagatggctaagcagaggctcagagaagtcagacaactcacccaggatcaagcagagggcaagtggtagattctagaatttgcatccaggcagttgagtctagaattgtctttgtgtattttgctccatggtctagcacaggatcmccattggtagatcatcacttagaatgccatcactaccttctaacagcaatcagtccccttaagtggctttcttctcttttttttcttttatctttktgttttttttttttttttgagggagtcttgctctgtctgccagatggagcacaatggcgcgatctcagctcactacaacctccgcctcccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcacctgactaagtggctttattttcttatgtggggatcctggagacacagtgtgtgccaaagcgtctgcagaccagtctgtacagttgattatagatatattaatgaccacttctgagctaaaaaatgatctagaataatagactaccaaacacataagcttatttacggtttgcctccttctcatgcttttggaagggaagcactgagggtcattgtatcagtcagcgtagactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaagacaagttcttaaagtttcttccaggacgtgacacctgacatttcactggccaaacacagtgacctggtcactctggggcagggatgtgtaatctccccatagctggagaagtaaataataatgcacaataacattgtctcccatgggtgcagatgtgatgctttcctccttgtgactgttttctgtcttgctgtcccaagtcctaaggtcccagccacctatggttctttggacctgtgattttcgctgaccccgaatgactggaggaactgctgcctgcatccccaacccagccctccttrtcagtcacgtagaaagcagttattgtttccaagttccctgcccttgttaaatgtcagctttgagtgaaaatgttcctaattttactcagagtgcaaagaacayccaggtcaggtacctgacctgcttgattcatgtcttggaaacactcctttgtctttcagagaaagtaaagagtgatggagacagagagagaaagtgtgacctactttttattatcagcaccatttcatctgcaaaacacgacttttctcttcttrttacgctgagcatgaaaataaaatgttttccaaaagacctggctttggctgttgtgaggaaggccagggacttgttcaaaactctgatgagctcgatgagcaaatgattccaatttttaaaaactgtaattgactttcaaactgctctcactgtccacacataatatgtggtacttttctgcaaataccagcagcaaggtaggacaaaaccagctcccacactggctgtttgcttgatattaagctttgccagtccaatataggtcacatttccaaccagattttgtgcttatctctacattacaccttgtagcaagggggaaaaaaagagcttcttgacatctttttgaagaatggcgctctttaaaaaaacataagggaactttttttttcaaacactgtaaygagggtattcaagtctgcaggcaaaacagagctgtttgaaaagacattagcctcgaaaccgcactgtgccagaatagatacagctacgtcaaaatgccgcatttattttgccattacttttcactgactaaaaccatttgctaatgaaagttctagctgccataatttcagcacctgctgatggaaaggtggactcactggtcatggggagtacagtaaaattaggagagtagatagaatcctgaagcatttgagctgcaaaatcatagtaacaacagctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctrttgtatttacagttacagtttattacagggaaaggatacaggttaaaattagatcggggaagagacaaatggggcaaagtccaagacaagtaccagatgtgaagcttctattgtcctctacccatgacatcaggacagaatacttttctactatctatgtgtggcagtatgcatggaatattgtcagacagagaaactcacctgagcctctgtgttcagagtatttattgggtcttcgttgcgtaggtgtgattgggtgattgcccacatatttgatctcagcctccaagtcaactgataactgtggtacagtgtccctaccctaagcaatattgttggtcctttaagaatggttcatctgcaacctaaggttacatgggtgtagttaggccccaccctaaatcacattaagagtctccagagtatgatcagaggtgcccaagcaaacaaagactctttttttcaggaatatattctgcatatatttcagtgatttttttttttttttgagacagtctctcattctgtcgctcaggctggagtgcagtggcrtgaccttggctcactgcaatttctacctcccgggttcaagcrattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagcttgggggtcccagtcctgggcaccattgctaagtaatgtggcctattttcaataagggcttattaatcatactaaaaataagaacttaaaactaaatttttatttgcctagaaatctaacatctttagataaaaatattccatattcaggaggcataattctttctcttttctttttttcttttttttttttttgagacagagttttgctcttattgcccaggctggagtgcaatggcgcaatgttggtccacctcaacctctgcctcttgggttcaagtgattctcctgcctcagccttgcgagtagctgggattgcagggatgtgccaccatgccaggctaattttgtatttttagtagagacggggtttctccatgttggtcaggctggtctcaaactgccaacctcaggtgatctgcgtaactcggcctcccaaagcactgggattacaggcttgagccactgtgcccggccatctttctttttcttcctctccttctaccttgcccaccatggcttaatttcaccagaatatcatcattatcaacatcattatttctagttcagatcattctaaaaatagagcagtcattttcttctatataagtcccaggtccagcctgctattttttgagcctacctttcctaatatctagtttatattttgttttgttctttcttgggattgggagtcagaatatcaactttttcagaaaagagctttggaaattctacatacataatatatataaattttccattcatagtgtgttagcagctttttctacaaatctcttggcgggtggggggatatttcactcttctatgaatcaaataatatatggctttttcctattggaaaaaattagtcgtgtgaactttattcttcaagaaaaagtagtttttatctgccttggaaatgtcaaaaggattcacragtttcacaagtgatgatctgggttgattgctaggaactgtttttagttagtttttttttttttttttttttttcagacggagtcttgctctgttgcccaggctggagtgcagtggcgcgatctcggttcactgcaacctccgcctcctgggttcatgccattctcctgcctcagcctcccgagcagctgggagtacaggtgcccgccaccacgcctggctaattttttgttttattttgttttgttttttttagtagagacggggtttcaccgtgttagccaaggatggttttgatatcctgatttcgtgattccacccaccttggcctcccaaagtgctgggattacagacatgagccgctgtgcccggctgctaggaactattaatccatagacaaggctctggttagagaagcagaaagaaggctgggtagaccggggaaggtagctgggaggtctctgaagcttggtcttgaagctgtgaattcatagacgtcttggaaaagaactttataatgtggttagacaagttttataagattttaggattaggaaggcttttttagggggtggggttgcttttaaactttgtttgaaaaatggagcttgctgccatcatatcatcatcaaaaatggaacttgtctatccacaaatatttatttaaaagtcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggatargaaagccagtattggtaaaaacatatatcagagtccttttgactgtttagaaagtgttaatttactccacgattatccattcaacatttattagttggcttctgtgtgggwgagtaaccattaataccttgamtaagtttataatctggtcattctgtagagcttcctatatgatgtcttctgtttaagtatttctgtaataccttatagacatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgttcaagaccagcctgggcaacatggcaaaaccctgtctctacaaaaaataaaaaagttagccaggcatggtggtgtgtgcctgtagtcccagttactggggaggctgagatgggatgattggttgagcctgggaggtcgaggctgcagtgagcaatgatattgccactgcactccagactgcatgagaacgtaaaaccctgacttaaaacaaaaacaaaaagaaaacgtgctcattggctaagcctggtagaagccacatgaccaaggctgatcattgctgccactgggtggcagcatactgggattgaggaaaataacccctcaactgcccggatgataaacacagagttctaaaatggcaacaaagggagatccacccttctcagttattgtttgaaaggacagctctcaggcaaaatatgtccacgaagttccatggaataattaccttccttggtgttaaaaaatgccctcacatttcaaacatgtcctgctttaagttcccagcgtcttaaccaggaactcgcttatgtgtgttgttttctgcttctttccactagggagctattgctgtaaaacagaaggggtagtattacagggaggagatgcacattttaaaatatatttctgcttcgtcaaactgtacagaactcttttcctcaatgagaaccaggtttttgcatgtatcttttgccaagatttgagaagggaagtctccaccttccagagctttggtcatattttgtttctctctaagggtgaagatgctgtttgttcttgcagggtgaggctttggccaataagaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggcaaaaccttacctctcaaaaatttacaagcttagccaggcatggtggtgcccacttgtggtttyagctacctgggaggctaaagtgggaggatatcctgagcccaggaggtggagattgcagtgagccatgctcgtgccattgcatttcagcgtgggtgacagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcagccatttaaaaacttgttttcagtcattttgcagaaagcagacgtacacttctttgctgttggtctgtgatgcgggagtggtttgtcagttctttcattcaacaagtgctgatctttgggcagcatacactggtatgacctttatcatttgttcaggtgttgtggagaaagttgtttgcttttgaaagacttgatggagaaaagtctttctacatttctagaaagaccatgggtgtgagtattgagagctgagtgccagtttgtttttttgtttttgttttcgttttttgagaaggggtctcactctgtcacccaggctggagtacattggtgcgatgaaggcttactgcagcctctacttcctgggctcaagtgatcctcccacctcagcttcctaagtagctgggagcacaggcaccagcaatgacacctgcctaattttgtattktctgtagagatggggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttcagggaaagaacatgacaccggcstccagcagagcctgctcttggtcyactgtttatcctggtgaccttaggcaagtcatttaatttccttgagttttggtgtaagtattgatggagcagaccatcaataactgttcttatgtctrttattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcactacaaccctatgtagttcacataactatttgcagttgtattttcctttaaatctaaattggagagaaggaaggtaattaaggcataattatcagacttaatcaagcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttgtgtgtgtgtgtggatgtgtgtgtgcgtgttatatgaagtcttgctagaatgcataaacaaacaaaaaaaatatcatactctcagatcctggatactgtggtcrcctggacttcaaaagccttttgyccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatctgcccgcctcggcctcccaaagtgctgggattacaggcgtgagccaccgcgcccggccccacttttcttgttgtgaatattttttccccttctgaagtgaatactgatttttcgttacagatatttgatgctttgggggcctgttaaaatagttgtaaatacactttctaaatagatgaaatgtaagaaattctgagaaggggtttctttgacttactggaaaaaaaaataataggaaagaaaatgtgatcagttggtatatttggctctctttcatcaacacttttatggacctgcattgcagtgtttctgtgatgtgtataaaacacagtttcagtgatcgtgcaagcctcagttttagaagataaaaagatatgaacttgaacccaagcttctctgtcaagagaattataatgtgttttgactgtaggcttccttcgagttaaatttacagtattttcccctaacaataacaacaaccagaagtgcccctttaagttgagatgcttgttaaactttacatgtatgcatgcatataaatgtacatttctgtatatataatatacgttcacatatagttacattagatttttaaagaatttcctttttgccttcaaatcattgcacagaacatccaagtagacatcatgtcaaaataatcaaaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagttttctagcagttctcttttttaagagcctcaagtgtccaataaaaagcaaatacttgaattttcagtttctatatagtgcatattttttctcctgcttgccttatttttataacagtgatttataaagacattactaaagaataggaaagaaggattttgaagaggaactgctatataacactgcttaaaaatctatttccaatgctaaggagaggaaaaaaaaatactggcaccgtatccgagtgggatctgggatccgagtgagatggccataccttcagtcattctcctccccaaatatttattgagcctggtggacaaggagggcgggataagattgccaggccctgcttctatttctggggttgggatggcgactaaagacccgcgtggactgcatgctgcagccagctcaggaaagatttcaggaagagcgtttaggaaggcagctttgaaaagaaaatggaaagatgaggttgcagagggtcagtccawggtgaccagaatctgacctggggcaatgccataaatccaagaaagactgggtttcaggtgcaggaaatgcgattgtgcacggacccttgcctttttaccmagtatctagcccatccttctttcttagaagcagaattttctaagaggtacacggtagttcaggataaaaattccctgtgctaactgcccttgcagctagctctctgtgaccgtgtgaccatgtgacccagttctagcgaatggggtggcagggaagtcccacatggacttcttgggcgtgtccttaggggaagcatagcttcttgccttcttcacactcctccttcccttcctgccgtctgggatgtggggtctggcagagaaacaatattgtgaatggaaatgggaggaacttgggtcctgaaaattacaccataccccagagcctggggtggattatttcaggacctttcttccttccttccttccttccttccttccttccttccttccttccttccttccttcctttctctctttctttttttattttttttttcagacagggtctcctccacacccagactggagtgcagtggcacattcatggctcactgcagcctcaacctcctgggctcaggcgatcctcacaccttagcctcctgagtagctgggactacaggtgtgcaccaccacacccagctagctaatttttttttttttttttttttctgtagagacggggtttcaccatgttgcccaggctggtcttgaactcctagcctcaagtgatccgccagcctcagcctcccaaagtgctgggatcacaggcataggctgctgcaccaggcaaggactttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcrctatgcaaggcactgaggtgacaaagacaagsagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttgaccttgagaaacctatagtctaatagaggaggcacatataaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtacccacttgatatggtttagctgtgtctccacccaagtctcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagackatatccacatcacagagagctggcccattgctcagggcctgggaagtggtagggagggaccttcccagaagagagatgactcaggctggtcccaagcccctcctgtagaacaaacagacaaggtgaggagcaaggaggcatttggaggtcatctggcccagcacccttgtctggaagacagatttaagttccataaagtcacttaggaggagaacatagtccaggttgaaccttgctgcctgccctctggttgaaacatcagtgttgaatcaatagaccacgtcctgtccataccttgggaattagactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgrgcatggtgtyacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagyccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagcactttcggaggcctaggtgggcagatcacaaggtcaggagatggagaccatcctggctaacrtggtgaaaccccgtctctactaaaaatasaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgcagtgaactgtgatcacgccactgcactgcagcctgggcaacagtgcgaaaccctgtatcaaaaaaaaaaaaaaaaaaaaaaagaaacacaacttaccaaaccaagaaacttacagagaacatgattagaagctagcatctgtttttaccctaccctcttcccctatgacccaccaccacgcaggccttgctaatgtggggtctttgtggaggatcttcaggatcttcagtgccagaacccagcatttaaactcttatttgacagtggggccacagcagatttaaaaggacaatgacatgataaaaaatgtgttcctgagagatttaaatgcaggcctatagagagcagatgttaaaagagaagaagcagactgggcatggtggctcgcatctataatcgcagcactttgggaggccaaggcgggtgcatcacttgagcccaggagtttgagaccagcctgagcaacatggtgaaaccccatctctacaaagaatacaaacattagacacttttcaaaagaagacatttatgcagccaacagacacatgaaaaaatgctcatcatcactggccctcagagacatgcaaatcaaaaccacaatgagataccatctcacaccagttagaatggtgatcattaaaaagtcaggaaaaaacaggtcctggagaggatgtagagaaataggaacacttttacactgttggtgggactgtaaaccagttcaaccattgtggaagacattgtggcgattcctcaaggatctagaactagaaataccatttgacccagccatcccattactgggtatatacccaaaggattatatatcatgctgctataaagacacatgcacatgtatgtttattgcggcactattcacaatagcaaagacttggaaccaactcagatgttcatcaatgatagactggattaagaaaatgtggcacatatacaccatggaatactacacagccataaaaaaaggatgagttcatgtctcttgtagggacatggatgaagctggaaaccatcattctcagcaaactatcacaaggacaaaaaaaccaaacactgcatgttctcactaataggtgggaattgaacaatgagaacacttggacacaggaaggggaacatcacacaccggggcctgtcgtggggtggggggaggggagaaggatagcattaggagatatatctaatgtaaatgacgagttaatgggtgcagcacaccgacatggcacatgtatacttatgtaacaaagctgcacattgtgcacatgtaccctagaacttaaagtataaaaaaaaaaattagctgggcgtgatggcacctgcctgtaccccagctacttgggaggctgaagtgggaggatcacttcagctcaggtggtagaggctgcagtgagctcacatcacaccactgcacttcggcctgggtgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccatggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcasaattccaggacgtctcaaatttctggctggtacaccytgggyaaggtccacaggctggatgggttttggaacatgtcttgattgtactttttcctcttggtttggaaagcaacrtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatggaagccaagagaagcaaggagtttttcatggttaaatcttgtaaagatgctttttaaagcatattaatccattagtaatccatttggatttgggaatacggtcatatactgtttggtacaatatgtactaaacctggtcctggaaaattaagtggaaatataggtttaaactactggaacttcaaaatagcttctcagtaattccttctcagcaatcattccaattcctagatttaaaaaaatgttgatatatcaaatttccatcaagaggaacatacatatggatttttggagaggggagcagagcagaagagaaaactttcaacttttaatagtatttcaaatttacctgaaagtgacccaaataatacaagcaactgtttaccctgattctccaatacacctgcatctttaattatgctaatttgatacaggtgtcagattatgcattaacaaagacatcctttttctttgagtatgtgttttctatggttatgtaaattatggaggtgctaaacatacctttagagaactttgtatttgtattaactttttttttttttttttttttttaatagcgatggggtttcactgtgttgcccaggctggtctcaaactcctgagttcaagtgatctgccttgcttggcttcccaaagtgctgcgattacaggcatctgccaccgtgcccagctatagagcttcatttatttatttatttatttatttatttatttatttatgagacaaggtctcactctgtctcccaggctggagtgtagtggcatgacctcggcttactgcaacctccgcctcctgggttgaagcgattctcctgcctcagcctcctgagtagctgggactacaggcacatgccaccatgcctggctaacttttgtttctttttaaatagaggtctgtttttactatgttggccaggctggtctggaactcctgaggtcaagcaatctacctgcttctctctcccaaagtgttgggattacaggtgtgtgccaccatgtgtggctatagaactttttaatgtgccaaggtctgtgttcagtgttttcttattcctcatctgacttagttctcaaagtccttgcctaaggtattgctgtcctcaccgtcctatggggagataggtcactttcccaagtctgggcagccagcagcagggctaagatcaccactcagaccctgtgwttttatttttcatctcctcacatctggcgctgaatgtcaggaccttcctggcctctgggaaagacacaggatggctgttttgagaggagtgtgaaatacatgaaggcaggacttccacacacctggacgtgaactagaggtgaggtggggaaagacaggaagtagatcagtgttgcccagaccctaccttttccaactagggtgtggaccatccttcagagcttggcctccaagttggaacccgtgtataccactgacagtgtttcctgggatggtgatatttatcaagtgcagaggcccagacacagagagcttgaggacctttgtgtgagacagtgaaaccctcaaaggcaagggctctgtttcatgagttttctatctcctgctgctgtctcggtgggcctgtttgagttgacctgtcccgtcggtattagcaactggcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacrtgggtactggagagtgggaggcccagtcasggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggyagccacaggagggctttagacaggacmgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgctacctggatggtgtgtttgccatcctcagtartgtgtgtcccttacagatgatgcccartgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggctactgaaatggcttagaatgccattttatcacatggtcaaattattcaatgatcaaatatcgaattattaaaaattatcaaaaggaagttccctgaaacatgaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggccsaagtttacccaattcractgcccccacccagatagaatattcatggttagaccataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactcacagccatgaatttcactgaagtttatgattggtccctgattgcctcacatcttgcaaagaatcctcttctagaaagcgttcttgcagttagattaacaagcagatatactgaactggtgcatgaatgaataggaaatatcccagttgcaaaggataaatctatcatgtagtggagagcgtgttcaggcaaaacatttggttctgcggtcgcttggaggattgggcccgtgctataattaatgccactagcagtaaaaggacattagggatgtcgcgcatgttgattatttcttcattttgtttatccaagtttccccgccttggaagctccgtggccattgccaaagaaagccctggagacagagcgttagccgttgctcctcgtaagcgcatcattaccttcctccgaacaaagtcctttttttttttttgtcagtagagggtgaaaacattattggattcaggagttcatagtagtcctgtatgaagctggggacggggggatagagttatgaaatggaccatttcaaatggcattatcttcccacagtgaggtacacctttcataaatcataggagagtgctcagaaaatagagcatttgttattcctgcagtacattgtatttgcatcccccctactcacaggaaagaagaaattctcaggtttcctttcccaggtttgaaaaggcagttaatcgccttacaatgaaattatatttttaaaaaaggtatcataatcaaataaaagaagtacttcatgtaagtcaaggattgtgcttttactactattttttctttttttgtaatcatggtggttctttttgcccacttatttaggccttaatttaattacggcgctgattaagttctttggttttattttttactgtaaacattgtgctgtattccgtaggaaaatgtagatgaatgtgggtcattgggaaataaagtgggtggaagtattggcgagcatttctttcccactctctacctcgcctggtctagccgctgataggtagttactctttagtatgcccaagttcaaattacgtatgactgtgattctaacacggaagcgccctccttttctagtagcttggatgtgattggtatggagaagcagagtgggtgcgtctttgtgtgttcttgacatagttaaagagtttggtatagtcaattccctttaaagtagtaggcttcttaaataattctagttgttcctcgtgctgccaagccatcttgaagaatttttcttcatttgtaaggggttaaaagtcatcaagctgattgaaaagtcaagaacctctagcgcagcctaccccttgcatatttgatactctcttttgcactctcgggagcagttttgaggacacactgtaaaaatgtatgacagcagtttgaagataagtctgttgccccaaataatcataagaagaagacagaagaaaaattgattcccgtagctctctgggcagtgggatgggggtaaagcaaggaattaataaaaacccaccagaatacattatttcagacaatcaaggagagcgttacattttaaaggtacttcatctcagaaagtttgagacatacttttcacacgtggcatgaagagaaaatggaatggaatgagcactaatgaggaccttgaacttaactaactgaacttgatggtcatcgcaagacataggggagaaatattttgagacatcattgtgcaggcaaacatgagcaagaaattgagaaatccgttcatgcacttctctctggtttcccggaagggatgaattccaaatcccgtggctcaggtcctaggtcaaagacagctctttagaaagagatgttctttgcttctttgctgactgcccatcccctcctctctctcaaggaaataagatattcatttgcaagtaaataatgcagcagtcttggatttgtatcagatcaactttgaatgaaagcctgcctttctgcgtttatttttgcttatctctcctgcttctgcttcctgttttgttaaataagggcaatgacggcaactattttaaattgctataaagttttagctagacagcgaatcaaggtggcaacacatggtgggttcttaaataatagttgtcatttgagtgctttctatatgatgtacatttcattttgcactttacaaataacctcttcctttttctgtttaatcttaaaaaagatcccgggaggcaggcgttattgtgcccatttcctggataaggagaatgaggtacgctaaacgagtaaaaagcaacccgagatccaaaccctttggcattcaagattacactcttattcactaactgttcatctcctccgactgcatcgccactcccccaggccagataacccatccagacctggagaactcctagagggagaaacagggaggacccaggcacataaacttgcagagcagctgagttatcagatcttccaagccatggggttatcgagctttatcagagcagccttgctcttgcagtttctgacacatcaccattgatcagtcctgggaaacaaacaaaatagagggcgatggctccactctgtgtggccccgtcaatggcctggacgcagctgaaaaaatccagaagagtgtaggacactggaaaagtagcagggtgtgcgattgcagggatgggaccagcagtaaaaggtagccctgccaagaccattaagcttcctgcaactccttctggatcccacaatttgaaggggaaatctttcccaccgcacatcactgtttggtggactaaatggctccccgatgtcccgaaagagcacagcttctggaagtgtggtatgtggtccctgagatgaagcagcagccacaggaacccatcattcctgctacccaaggcctccattgcctggttttctgttgtcagaagagttcattttcaggtccttcaccagatattttagaagctcatcaaggaaaggacgtttgaagaaaaacaaataaacaaaaacacaaaatcaaggacgtattgatttctgagaattcctcctgggttttgtttgtttgtttgtttgggggttttttgctgtggtattgtctgagcctatgataagattgttgttgattgatttttgtctttcaagactcagcacaacacatcccatccttctggataatctcttctaccctccctttccagataaaagttgactctcataattgtaactctcccctactttatcagcatctacatctttcagcctctaccacattgaattggaattatatgtctgttttatgtaccatgctgtgaactccttgaagataggagctgtcttatcttcaaggtgctcaagacacgtttgttgcatcagttgaatggagtcaaattataaacaggtgatgggggcaaatatcacaatatgatactctgaacatcttctctgacaaaaactggtcctcaagatacaacaacatttatatttgatttgtcttgctgtatcgaatcaagctgtggtcttgagtttcgtacacatctatgtaagcactctgaattgagtgactctttcccaaagatcatactgggatctttggaatgaatggcgggtcacccatccaattgcttttgcggagattcgagcatgtggggaatgcaagtcacaatatcctgcaaaagccaacttgagacctcctaggactgcactgctgcttatgacactgatccttagcccatctaagtaagtgagcatggccctgtaagtgaaattggagaggttccttgacattcccacatagctgcttccctggtaattcacctgggtccagaacacagaagggagattctaattgaaaaacttttcctaaaggccaggcacagtggctcacacctgtaatcccagcactttcagaggccgaggcagggagatcacttgagatcaggagttcaagaccagcctgagcaacatggtgaaaccccatctctacaaaaaatatagaacattagctgggcatggtggcgtacacctgtagtcgcaggtacttgggaggctgaggtaaggggattgctggagcctgggatatcaaggctacagtgagccgagaccgcacctctggagtccaccctgggtgacagagtgacaccctgtgtcaaaaaaagaaaaagaaaaagaaagaaaaagctttgcctgtatatgtagaacaaatgaaaaccaaataacagtggcaccagttcttctttcagtttccatggaatatcaagcacgatttgagttgagcaatttgatttgattgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttkgtttgttggcttatgttcgctgcttgrtctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctcyarttaattttactttaattccccctacaagaatgccgagacacctctgcctattttctctttctgtgtttgttgtttcttttgtttttgttttcgagactgagtcttgctctgtcgcccaggatggagtacagcagtgcaatctcggctcactgcagcctccaactcccggctccagtgattctcctgyctcagtctcccaagtagctgggattacagggatgcgccaccatgcccagctaattttttgtatttttagtagagacggggtttcaccatgttggccaggctggtcttgaactcctgacctsagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcasagttcaccctggaagacagagtttctttctgtcttcatcctagggcacaggagagatgcagtgatggcatgtctccactctgcagacatgttgcaggcctggaaaactgtgtggtgcgtctgtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaasagggactttgttcccsctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgagraaacgctctcttcttcttgcaggggagggctggcaaattcagygaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactmgctattatttatttgttgtcactgtttgggacccctgttgctgtctcaccaaagaacttcttgtctcccttttagaagtttccagagcgtcttcctgatgttgcatagagcactcacacctaacagatctcagaacttgtatcttttctgggtggctagactgaaaaatccattttcttatgagtgagccagaggtctgtctcttgcggcatttctgcttttgagaacctcccgtttcctgaaaggcaccagaccccaagacagctctgctgcctgattggtagatgcccatgacagctctgcttcatgcctgctgcctcctcatccctctggatgccttgtggtcctgcttgtctgaagagcataaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaataggaaggttatcctgggtgattagcatggatcagagttctcacaggagcccttcaaagcagaaggggaaggtggacaagagaatcggagagatgtggcrgagggtaggcagagagattgcaagcagggaaggatttcacgtactgccactggctttgaagatggagggggcacatggctagaaatatgggcggccctcagaagctaagaactagctctttctgacagccagaaggaaatagggaccttccacctacaatagcatggaaaacggggacctcagttctgcaactgcatggagctgaattctgccaataacctgaataggtttggcagcagattctttcctggagcctccaaagaagagcccaggctggctgacaccttgtgagtggccttgtgagacctgaaacaggaaacccacctgagccactctttgcctgggacttccaacccacagcaactgtgccgtcgtgactagatacgtttttttaaggggatgataatttgctgtggcagcaatagaaaatctgatacactgtcatggggccttccacagggtggggctcaaccagccctcagctcatctagcatgtttcctcctacaacctggactttttcctgttgtcccctcccgtgacactcagctccctgcattcaatagaattgcttttgtgggatgatgagtgtgttcagagtcatactcagcctaattattgcttttgaccaaccccaacacataatgctgtatgtcatgctgtactacttttaatttcacagatgaacacatttctgttcttttaatccacctctccaaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccgttgtagattctgacatgtcactccacatctttgtaactttttatggctctcagccctactttcttaatagtagcagcagtatttatctactgtttattgtattccaggtaaaggatatgygaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatscttttccaatattccctcctaatctttcagttgaattayggtctttagctcaaatgcrtgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaaggggsttttttgccttgtcagctcctgatgaaaaagatgttgggttggaaagctaagttacagcaggtgaacttgaatttgaggaaagacaaagcaaaccctggctattaaaggaacacacacacacacatacacacacacacacacacacmcgtttctggtattaggaaatggagatttctaacataataaaaaagattgaacttaaaaatgacttccattaaatagggtaagaattttgaggtggaatcctttttccttgggtcagtactttctgcaagcttctaagtaatggtttctcttagacactcacggtgataaaattgggagttttcaaatgaaatctggaatgatctactggcatcatgcctaggactttggaaaacttgaaggttggcacctttggggaaaaccagacttttgaagcaggggctctgattgtctcttcttattatagtgcaaggtgtttggcagaggtgtggtagctgaaggcccaaggataacattgtccagattttcagtctttggagccataaacatccagttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgaytggcaactgggaagcctaagggtggatctggcrtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcagcaagagtcccacggctgactctcattggccctcagtgggtcacatgtaaatcattgagccaatcaccgtctttctgtctggacctggaataaagaccaccttagagcatgggagcgggatccccttgatccacaccatatagactgtgaggtatgaagtacctcacagtaaagaagtcatgttattgctggaaaaggggacatgggtattaaaaagacaaaaacaacagggcttcatcacagcagctatactgctccatcaatacccatcccaggagacagtggcagtcttgatgtcaatcttgttttaggatcattgccagtggaattcaggactgcggttctacccggtaycggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccctcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcctgtttttgtgtttgtttattaattcctatttttcccacctgacagtacgctccgtagggcatgtgtttgtttcggttccccaacgtatccctactgcccagcagaaggcttagctgttaacaagtgtttattgaatgagtaagtgaatgagtacgtgaataaatctgcgctttagaggcacttgctcaggcttgtggaataattctacagagagaaacaggaatcaaagggaaacctgaagctggctcagaagatggatgggccagcaaaggcttcagcaaaaccacacaatgctcatgaaaaatcacgcatttctctgatttgtggttattgcttccctggattttttttttttccagttgttgttgttcatggtggtggtggacaatctgaccatataccaaccaaattgactgttaaattcaatcatcagtgaccactcctgataatctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagagaacaaactctttttaagggctttgcacactaattgtatgcaaatggatgctgctaattgcaaacacaaaattcaaacctagtcaaatttgaaacctgttcatcaacagtccctttaggacctctgccccactctatgtatgcagtttaaattgctgatttatggctacataatgtcttcctaacccccagtttactgttggcttccttcagagtcattgccccaggggactcattgacggcagagagtgtgtcccctccactgttgcctcaatgcccagctcagcccagtgggtaccgtacttcaaaacctcttattgaggtccacctctgtgccaagcatttcggtaggcagtgacagaagagagtgcatgcatgaatggataaactctttcctggaatgcctgctctcatcacctggtttcaaagtcgagccagacgttctgtctcagctcagattctacctaccctgaggttcgcagctgggcatgatcgagccactctccactctcctgtagcatttttgggctttgagtttatttgacacttttcacttgctgccttatattgcgtttatttttattaattacttcagtagtcatttacaaaatgctgctgaatccaagtccctgtgcaagatgctgcaggagacaaaaagatgaacaacacgtggtctttgctttcataggttatttctcctcttccatagcaacacatgtcaaggcaaggaccatatcttattcagttcctagtcatcttttctttcttttsctttttcttttttaaattgttaagatctgccataaaaatgtctgtcagagtaggcatgattgcatattctttagatggatgggtggatggatggatggatggttggatggttgggtggatgtatggttggatgattggatggatgatggttgagtgagtgggtggatggataggtggaaggatgaatggatgcatggctgagtggatagaaggtggatggatggagggatggatggttggatggttggataattggatggatgcatggatgtttgggtggatgaacagatgaatggatgcatggatgaatgagtagttggatggatggataaatgatgcatggatagatgaatggtgaaacttttatattttactaaaaatctgcattgatagcctagtggcttgctaaaaataagggagctgcccaaatgccccatttcctttatatacttgtggagcagcagcgaaggccaagccagtgccaggggctggaaacagacacataaataagaacaaataagatacagacctgacctcaatgattttttgatatagaagcataggcacataaataaattcctgtaatgggagtctagggtgaggggtggtgggtgccataataaaaattatataaagtgctatggggaagcaaagctacatgaccaatttgttctatttatttatttgttattattatgttttttgagacagagtctcgttctgtcactcaggctggagtgcggtggcatgattgtagctcactccagtsttgagctcctggactcaagagatcctcctgcctcagtttcctgagtagctgagaccacaggcacgggacaccatgccagtctaatttttaaattttttgtagggacagggcctcactgtgttgcccaggctyatctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcagctggaggagagactgcaggggtcagagatcagggccatatgctagagctgcartgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaaaaccagcaaatcattcatatttactttatgaaacctcttttaactttattttttatattttttttattttcttgtttctttttatttttaaaatttatttttgttttttttgttttgagacagggccttgctctattgcccaggctggatggagtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacamaaaaaacttttttttttagaactgttttagttkgggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacccagctcatttttttttaatatatatttttagtgaaggcggagtttcaccatgttggccaggctggtctctaactcctgacctcaagtgatccgcccatctcggcctccccaagtgctgggattacaggcatgagccaccactctaggcctgtatttgttttaattgattaatctacaatgacacatcatcatcacctaaagtctataggttcattaggttcacagttggtgatatatattctgtgggttttcacagacatggaatgacatgtatctatcatacatcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattctatctctaaaaacttaagtcaagggattttsaagcagttgtttgatttatgtatgtgaacctctcccttaggagaagaacttttctttggcaaacaccataggaacggagaccttaacaaaagaattaggactctcttgtcctgttttaatctcaaagctgtccctgcgctggtgcggctggcccacttgtgcctttgtgaatttgcagagaagaggctgggcgtggggggacacatgactaatccgccctttcttttgtttgtgcaacaactcaattcactgtcaccacatcagcacatttgctgcaaatctcagtgccctctcactttcgttttatttaatgcgtttctacattttcccaaggccacatgagctgttttctggcgcgtggtatgcctgcctcaaataactaacattgcctgggtcttggaatctgagccttcatattctccgatatattatttggtcctattgttccttaacttgctcatcattcacacggcgaaggaaattccatttggtccttttaagaccgccagactagctgacttaaacactcagctccagctacttctgaatatttcggttctttattgaaatggtccttttaatgtcatctttaatttaatcaaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatgktgccttgcagtttccaaagtaagctgaacagtgttttytaacagtgctgcccctctctcccactagaaatgcgagtccatccttttaccaagtgtggtacgacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccaaagggtgagcatagcttagtggggagagatttggactaaaaaataagagttctgggttcaagatctgaggtaaattatttgctaggccttagtttcccatctgtgaaaaaagggagttctataacagcaagacatttaatattaaaataatgtaatgtttttaaaaatgcttgtctacccactttttcttgagattagtaagaccatcttccaattagaatgtttatccgaacttaccgctaggtatttccttgtagagtatgaaagtaaaatatcaatgggccatctctacgtcaaggttctcgttcttctcattactgagaaattatgttcctggaataatattgtacagacttagaaataagggcattgaacttaattcatttatttttcaaaaggcatgtattttttacctgttgctatatctgctgccagccaagtgctgtgcttggccctgagaaagcaaagagagatagagatgtccatgttttggaacttgacgtccattaggggacataaacatttgaaaagataacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccagtgtcttggtgaaagatcaaagagctcatcaaaatttgtcggatagactgcaggctcagacactgatgagacccccctgcaactaccacatcaaaaggcctaggagcctttccatgaccaaatgcccatattgatgaatccgagacaagtgagggaaagatgtcctctgtcggtgttctgaaccctgtggaaatcatacggggaactataaaagatcctgatgcctggttttcttctggagagtctgatttaattggataaggatacagcctgggcatcaagagtttctagatgacctaagtaattctcatttgcaaccaaggttgagaataaagggtgtgtataaggtgagagacttctggttaactaaaggaaataccaatgacatttgtgctttaggtctaccagttagtgggtattggtgcatggtgggacagactaaatggctacaggtcagggtcattgtcaaagagtgagggataaggggttgtgctgtggctcagaggcagagtagactgaggaagaacagctaattccagaaagccatgttgtggtgtaaaagatagtacctgacttgtaatgtctgacaccaaaaatgaccttaatttgggtcataggacaaagacctccccacctccagctatgaaagacagaaaatgataggactaggcttcatattttctagcgtaacgtttggcttgtggtatattcaaaactaagtccgtgtttgttgctgctgagtgactgggctgatactacctgtccttcagccatctagacttgctctctaccatcctcaatacttcatatgaaaggagactgtcacttcatgaaaatcatttatttgctttagcttaaatctactggagattacaactgcctcattttgtcaccttcttaccccagaaggaaatatctccacaagagagcaggtatttattgagttatgactgtcaggcatggaacagatccattggtcagaaataaggaaattgtctctaccttcaaggttctcacagtctggagggaacagagagccatcagggacaataggtccctgtgccatcagctactgggatgtatgacttyccagtagaggtacacagcacttgttccaaaaggagcctatgtagctttgggagttctctatttagtcaccttattttttttgtcttcttgttaaactagcatcctgttttactgaatctctgcctcagttgctttatttactgtatacatacatagctcttttgaagacttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttctcagctcatggtgcaagttcccctgaaagaaagactcaagccaagcattcaatggttatgttccagatcatagtctcctaaaagccaggggtcctttatgcagggatggtgacatcagaagttaaaaggtctatgcagattaacgaggaaaaatgagggaaattactgtaaggtttttaaaacatgatagttatatatgaactgatgattatataattgaacgtgcctaaattgatgtagttctctgtaaaactagttggtgtaaggaaacttggtctttgaccatcaaggaggttgcagtttgtggcatggcacaaagataacactcagcagatatatagctatgggatacatggatggatggatggatgggtggatggatggatggatggatggataggtagatggatggatgcgtgggtgtgtggaatggtgggtggtaggtgggtacatagatggatgtatggatgggtgggttggtgggtgcatggatgggtgagtaaggggggataaatgaaaggcttgttcttctgaagggactctttacaaagagtctttgatcttccagcttcacgtgcaagagaatccccaaggtgagcttgttaaaataagcatattctgggtatcacttcctgattttctggttcagtaagtctgaggaggaacttggggaactttatcttttaaacaagtacctcaggttatcatagtagtcttgctgtcctgaatcttaatgcatctctatttctgctacatcttccatgaagttgattttgcagaaatcattctgtggttccacattgactgcatccaagacctattgccttcagatttacatcaagcacaatttggcaggtattagggatggacccagcagccaagtctttgttgccttaaacagatcccttgtctcttgtcaggacctccttccaggctgctcctgagcaagtctggatgtgacttctacctatgatccagtgggttgggccataaaggagctttggaaagggacagtcttagggtgaaaaagagggagaggcttgccatctgaacaggaatctctcccagaggagagaagagaagcctaggctttaatgaggacagccaccctgtggatgactttctgtgtgatgttatgtggaggtggcttcttttttctctatcccattagctgaattctgtgccagaaggaagagatttggagtcagcaaggcatccttttttttttttttttttttttttaaaaaaaaaaaaaaagaaggaatgtgattgtgaaggaagcaagaaaaggcccaaaggctctggacaagggctaggaggctgaggagttttacacattcataatttccttgtaggccaagcttactctcagggatgacagtcattttctaagaaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaattgtactgtaagtactctgatatgcaccacctagattctacaattaacatttccctctatttgcatctctatccatttaccattcctcttgtctatccatcagtctatcttgattcatttcaaaataagttgtaggtcaggtgcagtggctcacacctgtaataccagcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatcttaacttgaatcgtrtctcccagarttcccacgtgttgtgggagggacccagggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaasatatctgaaaatgtsgaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgactcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgacagaaaagaaraacccattttctggggagaaattcaagctggctgcagaaatttgkgtaagtggcaaggaacctaatgttaatstcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaatgtatagctcaggctgtggcttcagagggtggaagccccaagccttggcagcctccatgtggtgttgagtgtgtgggggcacagaagtcaagaattggggtttgggaacctccgcctagttttcagaaaatatatggaaacacctggatgccccagcaaaagtttgctgcatgggtggagccctcatggagaacctctgctagggcagtgctgaagggaaatgtagggctggagcctccaggcagagtccatactggggcactgcccagtggatctgtgagaagagggaaagtgaactaagctctttaaacctcatatgtttccatcagtaacatgggaacaatagtaacaattccacagagatagtattgatggttgaacaagatgtttaaatcactagtaaaatttggccagacacggtggctcatgcctataatcctagcacgttgggaggctgaggtgggtggagcacctgaggtgaggagttcgagaccagcctggtcaacatggtgaaacccyatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaattttggatacactgtgtgaccagctctgaggattccaagcttttttgcgtggcttcttacctatcagctaaagaacctagctttacttatccaacttagatattaaatcccatgatataatttatttttccgtgtgaaatatctcaggaacaaaaaagtcaggttgagttttctaaaggcactggtttaagaggctataggttaagaggagataacagacatgctcagaaacaaatcatttcctgatagctgtttcagatggaaccaaatggaaaacagtgcttctttccgtttactgtacaccccctatcctggcatctaaacatatttgtaatcatactgtctatagaagttttggttctgcttttgaccttaacactaaaatacccttccataatattataggcttttcatgtacatcgtttttaagatggctataaattccacttagtggctatgactgtagttttttttttaactcttcccctaatagtgaaaatttagattgtttctaaattttccttactataagtaaggctaaaaagtaacatgtgaatgttttgaatcaataaatatagtatgtattaataatattgagctatttcttaagattacattttcagaagtaagatcactgagtcaaagggtgcacactgtttaaaggagcttaaatatattgcaaaactcttttcatggtctgctgatatcactgaaaatggaggtctggattcaaatcacatgtgccaactgttctactttggcagaattacctactgctttgggcctcgggtactaaatttgtgaaatgggaaaaataatagttcccacctcatagagttgcagtggagattgaatgagtttgtagataaaaagcgtctgcgttgtgtctggtacatggtaaggggttcgtaaatactgagttatttcttattaacatttattattgtctccactggaagaagagcctgtagaatatgcagactattcaaatgcttcctttggtccattgttgtcctttcttttctcttctagaactttccccatagtcatgcatctgtccctgggttatctgatatgtgtttcagcctgttttcccaagtttacctgcctctctgagaagcccatcagccctgagagatacctggaaggaaagaggaaaatgcgtgattcaaatcatgttgcaagtggatgaatctagccccaaacaactgggaggcaactactcctgcctgccgaggcctttttttttttttttttttttttttttgagactcactctgtcacccaggctggagtgcagtggcatgatcatggctcactgcagcctcccgggctcaagctttccacccmcctcagcctcctgagttgctgggaccacaagtatgcaccaacatgcctggttaatttttgtggttttttttttttttttttttttcctgctgagatggggatttcaccatgttctccaggctggtttcaaactcctgagtccaggtgatccacccatcttggcctcccagagtgctgggattacaggtgtgagccaytatgcccaataccccctatgtagacttttaaagaaatacaggaaacagccaagactggtgtsattcagatttagcttgggagagtctagtgggtgttaggttcccacaggatgaaggatcaccatgaacggtcaggacctgacttaggaggactcagaagctggagactgcagaggatggcacagagttccaaatctttggggtgtgtaagagtaggagaggcaggatgggagaggatgggagtgatgccacataaatcaactctgttgcagcctccggggccacatcagtagctgcaggaggaggagggaacagggagacagggagcctttcttcctttcctcacccccagttctgtgtttatacttctcatttagcccataccccactatattaaaagaagatgtataagtgtatgtgtttaatctaccattccttgtggcacagtgcrtggtctgcatggcacagtgtgtggtctgtatggcacagtgcatggtccgcatggcacagcgcrtggtccgcgtggcacagcgcgtggtccgcgtggcacagcgcgtggtccgcgtggcacagcgcgtggtctgcgtggcacagtgcgtggtctgcatggcacagcacatggacatgattcatacatgcaagtgaatgagtgaatgggcgatttccagactatccagaaactgtgccccatagtcctacccgtaggaatccaacagggaactgtcaccaccgacccgaggcaggaaccatgtgctctgagccctggccattttgtgtagatggagataaattgtcattgctaattgccagagaccaggtcctggtggtagccaaactgttccctagggagttctcaccaaccttgcaaaatgagatggcaatcttcatcgtggatgcaattatgtttcattgttaaccatcacaagcaacgggacattatgatgactgttataagttggtttcacatgtaaactttgacctcagagcaatggggcaggcttttcccaaggaccctgttgagaggttcatgatggtgacaaaaagcacaagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggcyccagtggccsttgtcttgttatttcctccattagagacctggcrtataattgtgggagggagaagccagtggagcagtcaggggactccctggctgtttctgtgtctggtcttatgggtctgggcaytgaattcagtcacaaaccctagcatgctcctttgctacctcaggggacaaagtcaagaaaataacactaggattgccaccctgctctctctctctctctcttttttttttttttctttttgaggaagggtctctctctgtcacctggctggaatacaatggtgctatcttggcccactgcaccctccayctccctggttcaagggattctcgtgcctcagcctcccgagtagctgggattacaggggcacatgccaccatgcccagctaattttgtatttctagtacagacagggtttcaccgtgttggccaggctggtctsaaactcctgacctcaagtgatccaaccgcctcagcctcccaaagtgctgggatgacaggtgtgagccaccacacccagccactctctttcaactagaacagttcctctcttctttgttgcatatttttgtatttcatgcaaggtgctgtttatgaacaagggagtttcctgcagctttaataaagaagagaaaagaaaagaaagaaaggaaaattcgcatgttgaaaacattgtactaatcaaaaaagccagtcacaaaggaccctatgttatatgatttcatttacatgaaataccccaaagaggcaaatctgcagaaacagaaagtagagtggttgccaggggctggggatggggygtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtstaaygctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactytctctagttcactgtgaatggtttttgaataacatcaattagcataacctcatgcccagcatcgtccttattgttgagagcacagcagtgacaaaggtgcaactcttgctcttgagcgatcacagtttatttggggaacctggtactacctaataaaaccaggggagactcgacccaaggcattgtgtttgagctaggctttgaacaatgtatagaccctcaccaagtatggaagtggaagagtaagacattcmaggtagaaggaacagtatgaggaaagtcagagagctaacaaagattatagtgtaatgccagaatcatgagaaatttgctgagaattcatttgaggccataatttaaaaagataggaggagccatgtgtagaactttcacagaacagtgtgtacctcccctccttcttccttattagtcgtgattcttggggggcaactaaacccagcttttggcaaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccgggaggcggaggttgcagtgagccaaggtcacgccactgctctccagtctgggtgacagactctgtgtcaaaaaaaaaaaaaaaaaaaaaaaaaagagagagataggctgtttaacaggtgtcgtaggtcatgtatctacagccatggaaagagaatggagcactctaatggatccctgacgggtcaaatggagcaaagtgtgcttcccagaagagcataagaaaaaggaagggtactgggtggaccaaatctattgttacaatatcccttatattccttagggttcctttttttcaagttaaagcattgrgtcatgtctctgataaatcgcccccccaccccgatccccaccctctgccgcccyggccttctttttgtrctgttgggttccaaactttacctgaggattttcacatgcacatctgttaaatgccatttaaagagaacactaacaagagaaagctagttcatttytcttcctgggacctcagtttcctcatcagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgccggaaggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtsagcgccrtgtatttcaaagcaggatcttaatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggaagggtgaagagtagcaaatttaccgtcatcagcaggtgtstaaatgttccatttamattgaatggcacatgtcataaagtacataccgctgcacatcccaccctctgtttctgtttcaactgcagagcctatttttctttcccttccagctcagctgccttctcctccctgacytcaggtcacccaagactcccactttatgatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagagrccygtaattgattcataagatcccttcctccgatcgcattgaagagttaattatttttcctgcagttgggactcagctgttgtttccactgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgctttgcagaagtccgggctgtcatcctggcgtttgggtacttatgttccctagtggagacagccgggtagactggggaaggtgataaaagggagaaaaatagaactgttctagaacgatctccacttttaacagcacaatacagagaacagagctactcaataattagccaaccaagtatgaattctcatatgttcttaaagtatctgctgatttcttcaaacatctctaacaacatgtctgatgaatacgaagcctccctttatttatttattttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaraagtaaatgaaaagtatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggagaattttgtgtgtcacatcaataaacatcttaattgaacagcacgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattattgcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcgtgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccrtaaggacccttgccattaggascaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgtatatcctgcaccgttcctggcacagagtaggcactggataattatttcttggatgaaagaatgaacaaatgaatgaatgaatgaaagtttttttccttgcaaatctccctgcacactttaatcttaccagcatcttgtgaaacactcctacttctttctgatctttatttcttacgtagttttgaaatgagaaccgatgaagctgcttttgctcatggtacctcaggtcctcgctcactcccagcactcagggctgtgtggtcagagtctcagattcggagcatgtgatgtgcgtgggcctgtgactaacagccacatggcacgcaatggtggcagcctgggaggctgactgagcaagtaatttctgcttaagcaagaacgtgaggggtgatgtagttgcatgcactttgccatcatagcttgatctaggtctcagcctgggatcttgcagctgcgaaaagcatggcgttgcgtttccaagcctgaacatccacacccgcgaagataagaccatctcttggattaatgtgacgctgaaataaaataatccaaagagaaaatgcctgagacccaccaggagctcaccagatactacttctatcttccccactctaggtctttttactgcaactaccgtttaaaatactttttccatgaggcagatcttagtgctgacagtgtcagtgtctttaatgcctggttcagttgcaaacatggagggcagaggtttgatagcatccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcaastgtttgttttgaaccacttattttggcaagacttcttcagacaggagagccctgagagctcttcaaaggctgggcctgatggtgtttgtcagagaggttygagctcttaaatttaaatggcctcccacagggaagcagaagtccttttggatcctccagaggactgagatcctccagatgctgttcatttgccttattcgttatgaccatagaagtttgtggggtggcactctttattctgtcctcgccccgcaagcaaagcacacaccacaagctataaggagatgagctcagtaggcctgtcctttactttattttccctattagaatcccaccatagacgccctctctgcatgtgtccttgtctgggggagtcgcttaatttcctttttctttgaggggctataaaatttttgttgttacaaaaatgaaaggggagaggagatagaagaaggaaaacagtgaaagctcagcctcgaaagaagtgcttaaaggaaaggaggttctgacagagggctcggatcatcagcaggggcagggggtgcagggggtgcctgcaagtctgtgaccgtcctgaaggacccccttcctaggatcccaaacatgcactcccatcccagcctcacaccaagctcccatctgggaagcagcagacacacataaaagcaaggaaacttcaaggacgctttttgttttcccctacttttaaaaaattgaggtgaaattcacataatataagattaaccatttcaaagtagacagttcaatagcagtacattcacaatggtgtgtaaatacygcatctathtatttccaaaatatttgtatctccccacaataaaagtctgtaccaattaagcagctactacccattcctcttccctaccattctaccttctgtctcagtaggtttgcytatttgggatattttatttaagtgsgatcatacaatagcatcatgtgttcaaggttgacccacattgtggcatgtatcagtacttcattcccttttatcactgaatagtattccactgtatattgataccacagttggttgacccattcatccatccatgggcatttgggttatttccacctttttgctcttgtgaatccatgctgctgtgaataattgcatatgagtatttgggttcctgtttttaattatgttgggtatatacctaggagtggaagtgctgggtcacgcagtaattctttttaactttttggggaaatatcaaaccgttttccacagtggctgcaccatgttgcattcccaccagcgaagtgcaggggttccagtttctcacactgtcaccaactctgtcagtctattctggcactgctataaagaaatgcctgagactgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatcgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatcyaaaccttatcaccagcgcttgttatttcctcaggtacattttgatgtccctccccactttactctcccctacaccttgaagcaggtgcaatcattttaggctatgaggaccagcatcgaccttcatcagcatctgctctcctttacggccaggtctccttcgtcctccctgctcagaatttcagtctttttttttttttttccctatacagacacaggaagtatatattttcctctcgaatatcacttgggtcttatcttgttttatgctacatgcatgtggcttcccccgttacaaaaagaattcacattattagagaacatttggaaaacatacagaagtaaaacaagccatccccattcccacctcccagagataacgcctgtgttttagttcatctccttctaacctttatagttttttttctatcatattagttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaatcagctagcgatggctaaggctcctgtgagggtttctacagaggttccacccagagaggagagtcaaatgggagtttctaccgatgctcttgaaaggatcttgttactcagatgtctctaagacaatgatcagtacccatctctcagagcctgtgyagccgtccatgcttgaggcatgagatgctgaagataaaggtccccagtggtccaggtttttccttctcagcttggaaagcagcaggaaaactgcactgcatttatccaaagggtgtgattggtaagtgtgggtactgatatagaataaatcaacgtggctgggtgcagtggctcacgtctataatcccattactttgggaggccaaggtgggtggatcacaaggtcaggagattgagaccatcctggctaacatggtgaaaccccatctctactaaaaatacaaaaaattagctgggtgtgttggtgggcacctgtacttccaggtgcttgggaagctgaggcaggagaatcacttgaactcagaaggccaaggttgtagtaagctgagattgcaccactgcactgcagccttggcaacagagcgagactccmtctcaaatcaatcaaccagtcaatgtgtgcccccttttcctccaactcccaccccaaatccttgctgaatcatacctatccttcacctttataagcatctagtttttaaatctttgctgtgaagttggctgtgtgagctccatttgacagatggaaaaactaaggtagtttgccaaagatggctctttgccttcaggatttccatgtctttattttgagtaaacacttgcactgctaattttattccaacaatgtccttggaatggttttagttctcttggctgtaaccaagtctacacgataccacttgaattgacaacatcacagtcaaacctcaattttcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatttctctgcgctggctgatgcctgagccatctaatgatctttacgggaataaccaaaaatgctgggtggggggggaaaacgccagcagatctctttagggcagagtagggagggacacggacaatgtgggcagctgtccatgcagcacgtatcacatccaggatgatgtttatatgaagcatcatttttttttttttttaggtggagtcttgctctgtcatccaggctggcatgcagtggcacaatctgggctcactgcaacctccactttccgggttcaggtgattctcctgcctcagcctcccaagtagctgggagtaaaggcacatgccaccatgcccagctaatttttgtatttttgttagagatggggtggccaggctggtcttgaactgctgacttcgagtgatccaccggccttggcctcacaaagtgctgggattacaggtgtgagacattgtgcccagcttggagcatcttaatttaagccctctacatccctgcacggtagatacaaccagctccgtttccaaggacgaggagcaacagagtgaggtcatttccctgagttacactgaagatggtctaatttcaaagtccttcctgtgtccactttgccaggtgccccccgaaaagcaagaagactccttcaagcatcctgaagatttggatgctacaactgtatgtcctgctggagagaccctcccagaacattgaaggctccagtgttttgactggcagaatctcagtttcaacatctgtctctaagggctctggacctatgctgggtgaaacgtgttgtctgtaggatttggcccatctgagcctcactggggatgggctaaactccgtggggtttgtattccttctccttcattgctcagaggaaaagaagaaaaaaaataaaaagaaacgaccccaaacagcctctttcgtgcacacacgcctaagaaataggaacatgaatttgcattccttccaactggtgtgtttccaaaatacagacaggcaagtttgaatcactttgactttgaaagcgtgattttgagcaattatctggggaaaaaaatacctcctcttcactaaataagtctgtcaaaaagagtcatagtacagcgtgccattgccagaatacacgtgtgtgctggtaagctggccccaaccaattaaatagtgaaatgtcgactgcattcaggcccttcctggtctgcagacagacttgtgttagttcattttcatagtggtgtgtatgtatctttagactttaactgacagattcccacagtgagtagagtagggagttatcaattacatggttagctaggcgctgctattgtatgctctatggcttcttgacaggagcaggcagagaaggagggaaggactaatatttctggtgcaggaggactgttaatattttagaccgggctcctcaaacatgtatgcttatttagtgaggagaaaatgtgcatttgaatcctgcaaaccctcgagaagtttgcattaataaatagtgattaccagaatattctcttctaaaatatattttatttatcaaatgaatacccttctgagcccctctttatccttcctgtgatggctaaactaatttcatcaaattttgatttctgtgtggtgatgttgtgaacagtgcctgaaataataaaattaccctgagcagattgcatataaaactgtttgcaatgggagaagcagtctttggggctgtggtttcctttggctgcagtgtaatatattcctttgtttcttttgtgaagtatttattgtgggtctcctgtagtctgagtttcttgtggaagtgggcttgtgttttgcttttgtagactgacactgagaatagcatccaaacatctttttcccaccaaggcatcaaactccatcrttaggaattccttcatagaatcaaagaatcagaaagagctgaaacatagaccacggacactcaaattgtttatcctgaaatgaatgggaaaacctaagctgaagaaaggaagtgtctggccaagaagctggcgggagagtagaatcaggaaccagggcctcctcgtatctggtctcacgcttcttccgtggtgttctttcttaagttgagcattgcattctccttggataggatggatattttcctgggaaggatgatacatgatgtatttatccataaaactgaacaggtgttatgtgtgccttttctaataggaaagaccatcatgctatgaaaagagaggaaggggagaagaaatggggtacgttaagatctcagaatgagttgtggggctaaatgttcagcctgtctcccttttctccttgccacaccactagattatattttctagactctcctggtgttagatttggccttgtgacttccagccaatggaatcggctgcaggatgaaactagtcttgatccctgaatgactgcgtggagcacatctccttctggtcaataaggcatttcaggagtgagagataaacttctattgtgttaaacccctgtgactttgagacatatctcctacagcaggtggagttagcttaactaatgcagaacgataggactggtgaagcagtccatctgttatgagagctattctttttttttttttttttttttttgtgagatggagtcttgctctgttacccaggctggagtgcagtggtgcagtctcagctgactgcaagctccgcatcccaggttcacgctattctcctgcctcagcctcccgagtagctgggactacaggcgcctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtctggtataaccatgtggcacatacccctgtacatgtttgccaagactgctatatggtagagcttggaattcttaggagctttatcaggtaattgcaagtcccccacctcyaasaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaatgtttctgtctcaactggttgattggaacaacatacaaactgacccttaggaaccttctaccaaaaatatcctgtgaatcttcatacttttgtaatagcgtttagttagaagtggtcagactttcttcgtcctcttttcgtgatttcctctgtggtgtctgtggatcgataccggcagctcaggtaaggaacgtgtgcaggggatgtaacagaaaggagaaagacgaggaagaagggtgcatggagcgtgcaggggaagaactgattcttttttcagttaatcggctcatcaaggttctggtgttgaagtctgatttcatttgccatgttaagaggatatggacagatactgggcaaaaggaaaaaaaaaatattggatccttgcccagctccaagtgttgctgagtcccttgccccctccaccccgctctgtcaggagccaagctctggccgcccagtttttggactttgtaactgtttccgaacggatcagattccatctgaattgcagatggctttagccccagcagcagaggctgccatgacatcggcatgcgatttcttccaggacttaactctggagagagctccatttcctgttgatcatgagggttttacaggcacaaacgctgtcttctgtcactctgtcacagtgcattatgtcagaatagaggaagcagttcagcccgtaaatctgtgccaccggcacgcagggtgttgtgttgtctccaatgtgccttgtcaacaccacagggctaatagcagtgtcagggtccccgtgccatgaatcacttcacatctctggctagtacagatctctccctgtcactagtggaagtcgcctgcactacattcagaataggggccaggcgtggtggctcacgctgtaatcccagaacgttgggaggccaaggtgggaggatcacttgaagtcaggagtttcagaccagcctgacaaacatggtgaaacccagtctctactaaaaatacaaaaattagctgtgcatagtggtgcatgcctgtagtcccagctactcaggaggctgaggcaggagaattgcttgaatccaagagatggaggttgcagtgagccaaggtcgtgccactgcactccagcctgggcaaaagagtgagactccatctgaaaaagaaaaaagaataggcacagacaatttacctggatcctcacattgcaatgctgaccactccggaaggagtgtagaagttgcagctcatgcctgcattccaaatggctgccttctgcagtcccgtcagccaggatccctctcatacaaacaccttgactggccgagaaatgcagatgctgtgtcaaaagttcatggctcagagccaacaatgcactgtgctgacctccaattttccttgaggaggggcatcccagggtcagaattttatgcaatgcaagcttgtccacgatggcatgggagcgtgtgggaatgtcaagatgaaccggggctccgggagacatttatggagtcaggagcacacatacattcctggttctgtcagcatttccctaggcgagatgagtcacacatttatatttttacatatgcagcgcgcttgcaattttccactggggaagatagaaaaacttattgaaaatagttaatcagttttacaaagatgccataggtagaggtgcttccagacctatagttttgaaagtcacctagaggataccagtctgactcagagctttatgaaggcatattcctaatatcctccctgtgctccacgaagaacaattggtttggacatgaactggtttccatttttagactccaggcccacagtattctaagtaggttggggctgtgctgattgtaccactctttggattttagtggattttctttttaggatttcatgtaagtaacctgtgcagagagtgaggataaataagaacaagaatgacaaaccgataggctacttgacatcattccttaattccaggtcactggcggacatcactcattcatcagtactctgtttttctcccaagaatggatctgactcttgaattctctttaatagagtgttctgggaggctgttaccaattgaccagggttgatgcacatgttgaaacatctttgccatttcttgatagcttcagaagagattttaaagtactattattttgatgttgttagctttcaaagattaattccacagagatttttgggcatctttttgataatacacattatgcttgacttgggagtttcaggatgcgcaagagactccttttgactgcaaggactcagtaaaacaaagtatttcaaggtcatgctacaaaaagtcccaccaagagcatggtcaggaggtacagtgcacttacccacacggatcagagagggatcagaggaggctggctggggaaatgatcctagggctttcttaaaggacacagcgccatggttatttaagtacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccatgatctttggcatgtgagtggttttgctttgttttgacaatgatctttttgtaccttgtatcgggtaggttggaatgtgtttgaaaatttaagaatattttcctagcaaaggcaggatttttcaagtttgttcatgctggagctcctgccacgtattttgtccttttttcttttttctagcaactctcgagaggatgagacaaatggattgtgaaactggaaggagggtttctcattttttaatccattgttttagtgagagtttaaagctttcctataaaatatgtgggttgagaaaaattggaaaagacctcttcaaggactttcctctatgctccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaatttccagcaggactttcccaccttgctgtttaaacagtgaatcagccctgtgggctttgctgcttacaacatgattccggtgaaaccacaggtctcgtcatgtcccttctgtatccatggtagtcccagtgggaaagaggtaacaaacccaaattgagtaatttcaagaaattttaataacaaaggggctattttataaagggggggtggtcaaggtgtagggaaacataaaagagagcgaatttctggtctggtgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaatactccctctccccaggagaggtcccagcggaataaacatccccgccccttcaactctttgccattgttcaagccctgctagaaaccagatggcaaaaggaagttactgatgtgttcatattggtcaactttttcaggcacgaagaccagtacagaaggatggaaagtgcatttgggtagggaaatgggagattcctgcatagctgtcaagttagtttcttcccagagagaaagaccggtggctgtagtctgtgccccactcccagcctgtcctttctcagccgtggcttgtgtgcatccctggggccrgcatgttgctgcgagccccaatcgatcagtggagaaacgagctctggtgggcagtcaggcaaagcagatacacgtgcttcttttcagctttgttggaaggtttcattttgcttcasgaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccagctttcctcttcgggtggttctaagaattctaattcaattagaaggccttctttttagtttgattagttcaatatcaagagctaaatacattagcttatatatatgtctgatgaactcatctttgcttccttggatccccaagatagaatggccctaatgcagtcaaaccaccctgcagaatcttaacagcaccacaaatattgcatccaggcatcctgcccatgctggcttgcaggctggggatccctgtccatagcgcccatggctccaccaccagtcaaaggtagtggggccagcagtggactcctgtgtggttcagctctcaaaaatgtgaactgaaagacacagaaaaagacttgtgtttggggataaatactgagactgagcagtcttgtggattcaggaattgggcatccagttgggaccctttgcaagaagggtgttagggagcagagagcatgagtaagccggaagcagagcaggagagagaatggagcaggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcasgagttcgaggctagcctgggcaacacggcaaagscctcatctctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctagggaatggctgtctagcttcagtggatttccagrgtccggagctactaaaggtcaacagctgtgttaytgcaaactctgtggcctgcattctatcaatgccaaaatgcacatcacactgacaacagctctttgtttacaccggggagcccccaaagccccagggtaattccatcaccacccaagttktaagatggtagagcgaacaggccagaatgtgataaagtaaaatgaaagaagaaaaaggaggaaggaaaaagagagagggagaagcasatagaggaaagaaggaagaaggaaggaggaaggagggagggagggagacagggaaggaaggaagtctggcaagagggcacagtcagacctgccaggatccctctgctgtcttaatcaagctttgcctcagtctttctggactgaatttgtctctgtgttcacttggcattttttaaaaggagacaaaacaggtgatgaacacagcatgagtgatttttcccttaagagagaggtgtcatgctgagaaagaagaaccgacctccaggggagcttgtcttcagaccaaaaccctggcaaggacagcctgtttggatcttggtcattttgttagatttataaagtgcctttgaacagagcaggacactctggggacaagtcaaagcatggcagccttcagcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaatttggagtccatgttaaatccaggtcccagccaggcacagtggctcacgcctgtaatcccagcattttgggaggctgagatgggaggatcacttgagcccaggagtttgaggccagcctggtcaacacaaggagacttcatctctataaataataaaaaaattaaaaattagctgggtgtggtggtgcacacctgtagtcccagctactcaggaggctgagatgggaagatggcttgagcctgggaatttgaggctatagtgagccatgattgcaccactgcactccagactgggagacacagcaagaccttgtctcaaaaaaaaaaaaaaagccagattctccacctaccagtggtggggccccttgggtaacttgttttcactccctcagaacctcagtttcctttcctatacaacgcaagccataaggttaacccctcctcgtggtgatgttaagatgaaacaggaaggtgaggggcttaacacatttccgtgttcccataagctttcaggagatcttggtagttttcatctcggtcttcattaccatcatcactgcttcagactcctgtccatgtggggccctgtggtcttgcgatcacctccataaatgttcctttgttcccgcctaacacaataccagccacaaaataattctcaacacatattcattagtggatgcaggggcgaaatgaaactcagggggttgggaaactcacctgaaggatcttctccctctccccactttcaggctctcctttcacacgcatgcattaattcgttcattcttggaatctacccacctgtgatgtgctagttactaaagatgcagcaatgartgaaaggtaatcctgtccttgaggcattcacaggtaaagaagcctgcttgggacattgggccgtgagctccaacaatgtcactattcttctaggctttgtggacctttggtcaccccttctgtaagaccaactcccttatctgcctgtacagtgttctgcgaatcccggtctctactaaaaatacgaaaaaaattagccaggtgtggtggtgggtgcctgcaatcccagctactctggaggctgaggcaggrgaattgcttgaacccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgattcgtaccagctccccatcccttcccacgatcccatcttaatgtctgttgtggaagttggcccacagaagcctcaaggctaaccaacaagaaagatcacttcatatgcattagctggaaggtaacaagaggaaatcgcctgccagggtccctgactcccggaggaaagtgtcctctgagccctccttgagggacataaatagccccaaaagtcactgaatgctaagttggctttctccccaaaccttctaagtaggcaatcaggatttaacgacccgcaaatttccaattttttagtttatgaaaaaatatatctacatataatttttgcctccattagagtctcatctttaaaaaaaaaaattattcagtgacttcctccctctctttccaatgaggaaaactggactatttatgctgcattttaggctttttttcatatataatttttcatataaatgcacattttccccttctttcggggaggaaatttaacttttgtggaaatgtgatgtgtgtttaaattaccaatttcataggcaatatgtctgataattgcagagagatactgagttaacttgtagcaatgagtttctgtgacaaagggaaatcagtttgtttgcagtaagccgaggataacggcgccgaaactttactatttgggggtggggggaggttggggaagggaggccctgaaattgctttttataattaaaaagggaatctcagatgttttatatcttgaatatttacaataaaacctttaagtgcttgtcaagagggtaatgtgtcattaactggggactctgcctcgcctctcctctcggacatgacagtgcggctggataagagaagagtaattatagttcagcagggctgccaggtgtgataaatgactaatcagcacgcaggagcctcagtcctcaaaggaggactattacagtgttatcagctgcgggcctgggtgtacggagccccgaacagggatggggacaggaccttgcgctgtgcggcttggcatgctgctccagagtgagcccatggctgtctcttagttttgtcaccggcggctttatgtggctgccacggggggacaggaaacacacaggggctccagcaatctgcctggtgctaatatttatataacacactcgccagactccatggcctgagtccgggggtggcttttcggggtgcagcttggatggcatcagaacctgcaagaagccaagacgcctgttctccacggcggagcccgctggtcggtcactcctgttcctttcgtgtccgttgggtgcaggcattatttccagtgtatgtgaccgcttcccccgtgggaacagtgtggcattgttccctgggcaagccaacagctcagccctgtcctagagaaccctggagctacgacgagggtaccctggacccctgtcctaaatgttctttgactctgcttagccactgaggatgtttgcatttgattcatttgcttattatgatcaagaaacgttacctgtcaacattggataaaccatccgagggaaattaatcaaaacccccttcagacaaactgcatcacatcgattctctccttataggccttcttgttttgtgttctctgtgtgtgttttttttcccctagcgtgctgaagggtggcattggagtaccatttaaagaataatttttaagaaatgaacatcaggacatagacgtctgaatatgaggaagtgcctcatgtgaaaaaggacgtaatgtgctttaaagaaagaagaaggagataggacgacacttttgatacaaaggttatttttataatacttgcatttttatcggttcacgtattttaacagggagccctgactgaagtcacaaaaattatgactccggcaccgaggtacttatctgacaaatgcaatgcgaatggtcttgttcttatcaatgagatcagatttcagaaatgaatgcgaagaccgaggcgttgctttgtgcacagataaccttgcaggcgcaaactcccaaaccagaataaaagaattctctatgaaataatgggccaggaagcccaatcgcgtcacactgtaatagacagtggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttcttttttttttttttttttttgkttttcctcccagcctctctcctttcccattatgcacaatgcgctgagaaaggattcccagtccccctggtaaaaagtctgraggatgccgaggagttcactgtgcccttagataataacagtttgtcttggctctgatcacycctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgccccttgcccaattccctcccctctcctgcgtacaggtcatccctgagaagtgtgcctgtggactgcgttctttggggtaggacatggaatgggaagatgaaaagaaagccttcctttttctgtcctcagccgtaagaaagaatggtttcttcacagtgccgattggtaaaaccaagttctttgtaaattatggaacccaagctggaacttggagagcattcttctaactgaagataaatatggttgccactgtctttataaaaaaaaaagaaaaagaaaaagaaagagagaaagagaaaaaactgcaaaaccgcaaactggcttgttcttatgtggttgatggggacagcaagattacatatatagccagcatttgattctcaggactggtaaagtgtgaagaacagcagtgacattctagtcttcaataaatcactataaaaatgtttatgaaccctgcaatttactgtcttttatatgcaaattgaaaggggcatcattgcaagtgtaaaggagacccgaggtggcctgaaggaagtgtaaaatgttgcagtaggttttggagattgtgtgatcttaaatgggatcatttccaaacgattttgcgtttatacctctgtgacagttcgattaatttattaatgagattgctgtaagttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagacmmcttttcagctgggtgctccctggaagatggatcttgccttgtggatgtttttctaccgtgacagaagatagaaaggatgaaatagaaagagtgtgagtgaattctgcacccaccmccrccccccagcttccccacctgtaaaatgatttgctcaaagtttgcaaagaatggaggcatattcaaagtgctcagcactgggccggacccatgggtatgmattcataatgatcagcttcattctctccctttccctctctctccacacctttccattcctcctaactaatgtgggagagaagagaaaattacagtgagagatggtggtcagtttacaacagtatttagatgagaattaagattatgtccattcagggagactctagtgtgctctacatccccccaaaatgtggggacaatatggcaaatatggccaggtacagtgacagaaagtaaacagcccatgaaaacaggttgctctgcaattctcccaactgttcccttcccgcttcccacctgcctcgtatggaaaacacccaaagtaggcactgtttatagagccatcgcttgcagaacatctccccggcctccgacatatgtgccataaatgctgcagagctgcgtccacagtccctgctccggagaagagcattttgcttgttttcaaacacaagcatcctctcccgcgcctgggagggcgaggtgcggatcttttcgccttggcagtccctcgctcaaatgtgcgtctctggcaagtcctgtctgctgatagttgatagtgctgccacagagcggctgtcagattccaaaggcatcataccatctgcttttccaatcttctgctcttcaatgtagacatatgttcgagtggttcgtgtgtgtgcgtggtgaggggggtgctattttccgggggaagaggaggaggagaggatgcttaactccaagagtcctcaaagcaaactgaaataaaattttaagtgatgccaaaataagcagtcccagcaagacatgttataatataaggtcctttccttaaaaccatacctatatcagctttggaaataacgtacctcttaactgcatggaaaatctagaagattcgtggcttgggtctgtttctattcttaccacggtgacacgcaaaagaattttttaaaaaataggtttgttgttatttctgtatatctgtatgggcctgacctcccttttctctgggctttctactccagatttttattttatttttacactttcattgccctttgctctttctggctttcacctaaacaatagcatgtatatacaacagtacctataaaattgacgctcgtgtcactgatcatgccaagaaacctaatgtatggtgaatttgcactagtatttatttcctccctccctgtctctcccctctcctcccctcccttcctttccctcctacccctctttctttgtattattcccctagaaggaaatattcaagctggctttagagaggatagcaattgtaaggtcaaccaagtatgggatggggaccggaatagattttctctgcagatttcacgctgccttcccgggaatttctgaatgttttgcagcctaatgtttagcttccaacattctttcttttttttttagacagagtttcacccttattgcctaggctggagtacaatggcgcgatctcagctcacagcaatctctgcctcctgggttcaagcgattctcctgcctcagcctcccgagtagctgggawtacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaacattctttaagaaaactgcaccatgagtaaaatggggacgtttttctcttctgctgggacccaggacatgttggactgcacatcagttcattctctctgatctaaggtgttggctgctcttctcccttctccactgggctctgagcttcttgagtgaagggtctgtgggttttcacgctttgtactcgggcccagagcagagcctactgccttcacagaagatgctccacatgtgtttgtagaaggaacttggaagacagtcagttttaaagattttttcactgagggactaagagaaatagaaacagaggggattggccacacctgaagtcattctgtgttcaaatcttggctctaccacctatgatctgggagctsttagaggagttaatcgatgtagttaagactcaatttcttagtatatacaataggtgtaatagtaaaaattagatgactttgatgtgtgtaggtaagcggctagcacagtgctcagcatgcatgaaggactctttcattatcgttattaactgatgtttttaacttatacattgaaakgtggaaacaagcsttgcttctattgaatgacttcttgaaagtgccagtctgatccttgaccttcaggtgcatctctaaattctttcatgtcagggtctctgaaatctgaacacatctcaaagttcccttatgcctggcaggggcggtgtccgactttgttattgcctatgcatgtataaatgtcccaaatgccagcaaccaaacttgcaggatgggtgttgacagattccaggaaagtcccagatgtaacagcggaatattccaccttctaggaaccaaatggctgtgaagtggagagacaggcagagctagaaatattccggacgtggaaatcaaaagtaggtttgcgcaacacaactgcagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtctctactaaaaatacaaaattagccaggcgtagtggcacatgcctgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattttttcacttacattttatagtatttattgtatgcaccagagtgattggtgataaaaatggaggcctacttaagtctaagagagttcttgtgaaagtgggagggggatgagggttggaaaattgcctgttaggtgccatgttcactattcagatgatggatacactaaaagtgcagacttcaccactacgccatatatgcgtgtaagaaattggcacttgtacccttgaaatacataaaactttataaaaaattaaaaagagttactgtaatgattataaaatgaaaattctacgtcatgagaaagcattgtgccatattttcaccgggagcatttttttttccttaggggaaatgaaaaataatggcatctatgatcttagatttagtaaaacgcagtatcttcttccccagctgaaatagcgaaagggtctcttcaggctcctgggataaaaaccaggatscttcatgtgtctgagcaggcytcccaccatttgactgctgctcctttgtccagacacatttaacaccatctccctgcaccccttcactgggctccgaagctgcgttcacacggcacgtcattggcagctcatctcagaaggttccagctttgcctggcaaattctcctccttcctttagatcccatctctggtagacagagtaatgagycccgaagatgtccaggccctactcctaattccatggaacctataaatatgggaggttacatggcagwtggggaattaaggttgcagatggagttaaggttgctattcactcatcttcagattgaaagatcatcctggattatctgggtaggcccmgtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctstcccagaacttccagaaaggcacraagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcaggaatagtgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacacatatcccacatccaggtgccagtcagggagctgcgatttaatttgctgctgaatgcacttttgaataaagggcctagaagatgcagtctcgaggaacsgaggccggttagagacaggctggcagctttgcctyctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagayttcaaattgagcyagacctcaggcatgaagggaggggagagagggggaaatgtggaggaagggggcgtttgtgcagtgggaagttggagaaagtacaaatgaaagcctctctgcagtgaacctcatgactgctttagagaggtgcttatgtaataactgcagtggtgtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgtaagtgtatcgacgtgctgtactcctaacacattatttgttatctgaaatttagatttccttgggtgtcctgcctttttttttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcaccyggcccctgcctttttattttgctaaacctgatgacccttgccatagcagaactaaagtgatgatgatgattacagcagatcarttattttgagctctgastttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtataccgggaacagaacatatatggtttcatttcatcctcccattatcaccgtgaggcctcttccgcttatctattgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagggtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagtcaccactgtatagtcctgagctcactgggattaaggggaagggacacagactccacytctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacytggccaacacaccatgccttcccagtctctggtgttactstctgcatactgtagaccatcatcttgtttgcatacttgtctgttatctctttatcatccktctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccatatacctcaagtaataaaaaggcacagcaggcacttgggttttccctcagcttgctggggccgtgcacctatgtgagattttattatttgtaattttgggggggttaatttcacagcttaattctggcctttatgcatttagagctcccctcttgtgtttcagaaaggaggagttgttgttttcttttcacttgagtttaataaatgaaaaaggggaagggagagggaargaagaggaaaaagcacaaatgtgcttgtttttggatcagcccctgtactgggcacatggatgcagtcagtcctcagtgtaccccaggaaagaggaaactgagtctccatgtggctttctgtctggcctttctcttttgcttgccttgtgctttgaatgcaggcctgmtgtttgcctgtggacctcaggatttgtaaggccatctccacccacctacagctaagtttcccaagagccgatctccagccgaagtccaaggttccttgatgacccctgggaggagatgcaacacacagtttcctagaatcatttactccccaggctaagcacagtcacagaaatgaggtagctgtagccaaggatgatggcatagcacattcgtttcttaggcgtgccacgtactaggtggcttcastcagcagaactgtaytttcccacagttttggaggctcaaatttgcaagtcgaggtttcggcaaggccatcctctctctgaaaactctatgggggcgtcctctttgcctcttcccggcctgtaggtatttcctggcaacctttggtgtttggggcatgttgtcacctcattgccatctctgcctctgtcttctcaccaccatcttccttgtccatgtctctctrtgtcttcartgttcttcttatarggacaccagtccttggatttagagyccaccctaattcactgtaatcacatcttacctaagtccatctgcaaagaccctatttccaaataaggtcacattctgaggccctgggtggacatgcattttagggaccctttcaggccaccatatatggattccagagtgaccagtagaacatagctcaggccaagagagaaactcaaccttggtgaagttgcatgagaacagaaggcagccctggtccctgggagaaacccatccatactctggttacccactggccattcctggggacaggcggcaggtgtttagtcccctctctgcaaccatttgcggtcacctcttatgtgctaggcctggtgctcagcgctgagtgaacccatatcaacaaggcatggtcactgcgctagggaagtccctggtccagtggggtgagggtggcagtggctggcaacaaagacaatgagcgctgagattgaactacagaaagcagaagatggggtgacaagtttggcctgcggcaggaaagacttcccagtctttaaggataagtggcatttgatgagttgcacaaagaggagacctgtcctgggaatggaggagaagatgtgaagcgcgggaagtccagggacacacagccgtgcagagacccgggggcctcagcaggttagagtgtctgcatggcaccggcagaggatgaagacagggctggggaggggcatggggttagcctaacaagggcatcaggtgccaggttagagtttcggtttctaagctgtagataacaaaaatttcttgaatgcttttagcccctgatctgagttacgctttttttttttccttccattttccatccaacagacatttgtgaggcactgtatttgttttcaattgctgctgtaaccaatgattacaaatgtaccgtcttaaaaacctaaatgtattatctgacagtcccataaggcaggagtccaacacaggtctcactcggctaagatccaggtgtaggtggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccactttaaggacctttgtgatagttttgcacccactggatgacccagaatcatcttcctcttttaagatcagctgattagcaacgtcagttccacccacaatcytcatttccctttgtygcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagggacttacataaatagagtaatcaggggagggcccctgagaaactctaaaacatgaggaaagggctcatgatgtgaagaactggaaaggtgttccaggcaaaaggaatggcaaacacagtggccctgagacactcagagaaatcactcaggctgccttcgaaaggatgtattggagaagatgaggccaggggattgttagtaactgttgcaaggatccgggagaaagatgatgaaggccttgtagggcaagctggataagagcacccaaaatatccataaccgaatccccactacataggcatgctactttatatggcaaaagggaatttgcagaagctaagcactttaaaattattatctccttaaacctcactgcagagttataaggaaagcactgttatcagatgaagaagtagatttcatcaagtgactcacccggtatcatatagctgcttagcggcaaaaccaggatgtgaatggagagctctttctcggataccaaagctatttaatatttatcattgactaataatggtagagaaagtaatcatcataacctctgccctttattagtcactcatggtgtcacaagccctttacaaagcactttgcatgcaaatgattcctcataacaaccttgggaggtagttactttcattgtattagctatctcttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagygagggcccagccccttttaagggcctagcgattagatcagtcccacttaggattgaatcccttttgattaatgcaaaaccaactgcgttcaggcctccatgacatctgcgaaattcctccccctttgcttggtagcctaactcactcaggggggcaaattatcccatcatattcacagttgccgcccacactcaagagaggggattctataggaaatggaagtcttgggggccatcttgaatcctgactaccatagtctgtgaaatcccyatttcacagatgttgaaactgagacttagaagcattatgcaccatgccaaaggccatggaaggacagagcttgggcatgcycccgacaccaggtcatactgatgtcactctccctactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagggggccccgatcaggtggcagggcctttaattggagccacgtktgtataatgagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctgtggctcttttycacaaatgcttatggagctctaactgggggcaaggaactgtgctacggttgggaagagaggagtgggcaaaaggagacactggggcttctgtgactttagaggcccatcatcaaattttcttttttttttttagatggactttcgctgtgtcacctaggctggagtgtagtggtgcgatctcggctcacagtaacctctgcctcctgggttcaagcgattctcctgcctcagcccataggcacatgccaccacacctgactaatgtttgtatttttggtaaagacaaggtttccccatgttggccagccttgtcttgaactcctgacctcaggtgatccacccacctcagcttcccaaagtgctgggattacaggtgtgagccaccgctcctggcacccatcaaattttcaaaggaagaaatggaatggtgcaaccatggtacatgggaaggaggagggggacacacaagactgtrcctatcatgggggcttcgacctcatstgggaaggtggttggagagagtgagtcctgacctgagctttggaacttatcaagttgagagagaaatttgataatttgtctattaacgtgtgaccttgggcaagtcattgaccttctctgaacctcagtatcctaggacttcagaagcgaaaggaagaataatgggtcttgagtatgcctagaattgagcaagctgctatscttgcaaaggccttggccagctgctcacccaccatgtccctctgttcccactccaccttactcatgcctagacttcttgctttttaaaaataatccacccatgaaacaagtgtttatttacaaggctggcttccccaggaggctttcacaaatgcttaccgagcatctgctgtgtgccagacaagagtgaggagctggggactcagagaggagcagacgagggagacactcacattagagagtggcgtgtgctgagggaaggtgcctcaggcgacagatgggaccagggcctttaactcagtggcagcttcagagacagatctggaaccccaggactcaaaggacctatgtttgctaatcaagtgaacacggaggacctgccactgggcagggcatccctgaccaatccacaggtgatggcgggacagctccaggccctggggatcccccagggaataagccagattaaagcccctgccctgtgaggtgtggcaaagaaacagacaattcatgaaataaatatatgataaataacatatgagaaggcagggagtggtatgaaacaaatcagggaaggaggagacggagaagttggagaagacagtggattgtttctctgggtggtcaaggaaggcttccaggcagaggaggtttggccatgggtaccaaggggtagagatgggaaccttccaggkacatggacccgatgctgccagcagaggggaaaccatggccctaagggcagagcacactggggcgggggtgggggttcagtgacagtctggtggcctgtgtggtgaggagtgcgggagatgggaacagagagcgagagggcagacggggtcatgttgtgtgggacctcggaggtcctgccatggctttggtttctacttggagagaaatagggaggtttgggcaggctctgagtagaggagtagcacgatctggcttacgatgatttctaacatctcaccatctttacttctgtatataaatatatgataagtatacctttatatatgtgacatgtatctttayatatgatatgtatggttacatatctactcactcacacatccacacacacacacacacacacacacacacacacacaccttttttggaaccattgaaaagttgcagacatcatcacggctcaccctgaaattccttagcaggcatcttctgagaataaggacattcttctatgcaaccatttcacatccacactaagaaaattaacactattacgtagtattatctaatatgccctctacattcaaattttcatgtctccaatcctgccccctttggaacttctgttggtgttcgatctggaatctgagaattcccttgcatttggttttcatcccccatagtcttcctttttttattttttattttatttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaactcttttgtgttttagaaatggggtctcactmtgttcttcaggctagtcttgaactcatggcctccagtgatcctcccgcctcagcctcctgagtcactggaatttcaggcatgagccactgtgcctggcctctgtcaacttccttatctagaactatctttttcctctattgttttgtccctcacttctgaatagttcagggatccctctggctactgtgttgagaataaagtgtcaaagccaacagtggaagcgtggacactgggtaggaggcttttgcagtgctctcggcccgcgctgtccaatagaactttctgcagtgatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcartttgaagakccacatatggctgagggctactctawtgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcctggctgaagaaaggcatcacaaagaaaatgccaccagcaggctgggtgtggtggctcatgcctgtattcccagccctttgggaggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctgrtaactcttttatcttccctggagttatttttttcccttctttstttctctttttctgtgtgctcttctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgmctgggtcccgkgtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggattttttgctctcctccttttgtcagttggcatgcgatatgcttctcaggcagtaatttagagactgtcaattcctgagagccgctggggaactgagcaatcgyctgcatttcgtcgctttarcccgagctgggtctttgagctggcagagaccaagatctttttctgggaagggatggtcctatttaaggaaggccctggattttgtcaagtttgaaaggttttcaacatcttcccgagatggtggtcatgggagtagtggttagggtggttatgacgcatgggacgggagaataccatgcccacccggtgatttataccaaaagatgctttcctggggtggttctgctggcagtcgggcagtgacatgttattaatgttttcctgttttctattgtccccgaatggaaaaacactgtggaacctttaaattttctcaagctgtctatgttttcctggatcgtccctcaattttccgtggtatgaaaaatgtaaatgttgctacattcagttcagggaaatccagccgttgctccagatccttctaagatttttcaattccagagatgttttcacctggaagattccccagatttggcaaaaacaacccaactcctagccactgctttttgagcagctactcagtgcctwagactttgaatagtttattaatcatgtgtcactgcagcaaaggggacatttcggycctgatttcagagatgaaagaaccaaggcatagaaattgagtcactttctggagtgtacacaactagtaagtggattcgagttagttttgctctattccaaggctacttactatgctatttttggtttcctacttttgttcaacttatatttatctgattatctgattctcttttacaagcacttagtgagcatcagctgtttcaatgagcatttatttactgatacctgtggtggcacccaggaaggactaggaatgctctgtgatatgtaggagaaggatgtatccactgggcaaaggtacctgcgagggatcaaagatggaaaggcagaaatccaaggactacgtgtgacatgaaaggggcctttctcctgctgtcatcctgaacctctgtctttcaaatttggatgtgtcgggggccacaggacactactgtgcatttgcctgtgatttgccattgggttggagtacttctcctgagtttctgcagtgttctaggtatggtcttaggccctggarwaagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttmagagttaacctgagtgtctgctgcatagtaggtgctcaataaactataacstctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttatttttrttttaattaaataatttatttttctgagacagactgtcgctctgtcgccaaggtggagtgcagcggtgtgatcttggctcactgcaacccccgcctcccgggttcatgtgattgtcctgcctcagactcccgagtagctggtactaaggcatgtgccaccactcacagctaattttagtatttttagtagagacaggatttcgccatgttggccaggatgatcttgatttcttgacctcgtgatctgcccgcctcagcctcccagagcgctgggattacagacgtaagtcaccacgcctggcctgatcctgacttagttacggttacctctctttgtatctctatatgttctcaaattccaacctgtctttgtaatcctctatttaagctatcgattacctccaaaaggccctgaatgtttcagaaagaaaggatctactggcagcttctgaaggcttctgtaataccttgtaccccaatgagtacaatgaaatcattaggggttctttcctctcctttggaatgaaactgctgcttaacttttctcccactgatgagatgcggtgatgctgtcacagttgggtggttgctcctcctgcagtcttcttcccattgcatgttcactctcttccccacttgcccacgagcagcaactcctgtttcttgtttttttccttttctttttcttttcttttgagacagagtctcgctccgtcgcctgggctrgagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctggggtcgaactcctgacctcaggtgatccgaccacctcgacctcgagaagtgctggcattatggatgtgagccactgcccctgccctagatggtatcaccttcaaagcttaattaggaagaataatatgagcactgagtgtaactccaggtcgggtatattatgtccctctgtgttctctagctagttatctatccatccatctcttgccttgtccacagaagttacaggtaggctgccgggcgcagtggctcacgcctgtaatcacagcactttgggaggccaaggcgggcggatcacgaggtcagaagttggagaccatcctggctaacacagtgaaaccccatatctcctaaaaatacaaaaaattagccaggcatggtggtgggcacctgtagtcccagctactcgggaggctgaagcaggagaatagcgtgaacccgggaggcggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatatttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacgttttgatatgaatatttccacccccattatttgcataacaaaktacagattatccagaacaggtgggctgtacataaacaggctggtgggctggatttgtcctgtggactgtastttgctgacatccaggctagatccttaatatacaatgaagtagtaaaacacatgtaaaagtaaaaagcaggcgwaatagaataaaatasacatttgcacaccacagtatccaaaaaggttatgtactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctgacagttgttaattaaatacctactcatgctttggagccaaagccaaatagtgctctgtaaacattatgatttgtcagtaatcaatgtgatttgtataatttgtgagcaatcagatactttatccaaaagcrgattattgacctctgtgcccatcttgggagaaattgccacttggtctgtgtctacacagacccaagaggagaagggatttgacaatggtctgattaattgaatcagtggtttgggggagtgggctgtctgtattgatccaattaaatagataattgtcagaatcgaggtcatgtctataagacaccaccatttcaaagccaaagagattgtttcaaacatatcatgctcaccccaatcaatgtgggccgcctcctccacatgaaatcaaccagaaagtgattgattctgcagagccataaaccagggtctttcctattttcggcaagtggttctgtgctaaatacagtgctttgaaatttttgttccccatagacccaaggatgatgattcattatgcaaataatggggatagaaatatacaaattgaatgttagggctgggcgtggtggctcacccatgtaatcccaacactttgggaggataaggtgggcggatcgcttgagctcaggagttggagacaagcctgggcaacatggcaaaaccccatctctacaaaaaattttaaaaatttagccgggcaggcatggtggctcatgcctgtagtttcagctattccggaagctgaggtaaggaggatcgcttgaacctaggaggcagaggttgctgtgaggcaagatcacaccactgccttctagcctgggcagcagagtgcgaccttgtctcaaaaaaaaaaaaaaaaaaaaaaaaaaaagaaaaagaaaaaaaaagttggaatgacatcagactcaaaatgtgtcacttcgcagtggggatgcaattctgagaaatgcatggttaggtggtttcatcattgtggaacatcatggagtgcacgtacacaaacctagatggtgccgtctactacacacacacttaggctgtatggtctagcctcttggtcttagcctacaaagctatgcaacgtgtgattgggctgcgtactgtaggcagttgtaacagtggtatgtgtatatctcaacatatctaaacatagaaatagtacagtaaaaatatgatattataatctttgggacmgccatcatatatgyagtctgtcattgactgaaagttgtcatgtagcccatgactgtcgtctcttttaggggaaaaaacaaaagcagaaagcaagcaagctggtatcctgcgtatctgtgagctcaggaagcagctgcatgtgcatactggataagcaagggagactccaaccccgggctctctaagggtgtaattgttgcaggcacactgaggggcagacctctgggtcttggttagtggtccagagagggaagagagcaaaggtagaaggcttgagtttaatttctgcatcagactcaaaacccagctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacamctactacatgctaratctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaagacaggctagcacatacaacacaatctataaatgtttgctattattgtcatcctttttattagtatatcatggtacaagtttgctgggtagaaagatggcgatggggaaggggacatttcaggccaatgtgataataaaatcaacagacaaaagaagggagagtgtggtgagtaggataaagctctgtacagatgcaaggggaagggtgttgatgtcaacacgcatgcagcttcccacacgtcgtgtggattcttttctgtgctctccattacggaatctccctgaaaataagtggtcactttgaggtttgatggtttaattctaccacaaaagtataaaaagcaggcagcctgctgtttatagatttttttttaagtgagggagtatgttaatgagcttagattgtcagggagctaaggggattcttgacatcaaattgtgggtagctaaataggtcaccccaagttattcagcatgggtggaagaccaagaggatacacaagcttcaaaaagttttcagggagagcaagagatgttcatttacctcattcaaaatggaatctttaatgctagtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaagrttagcgagatattgtctctactctcaagaaactcgctttctttgggaatcatcacctgtttttgtgtcayggaccccttgggcatttggtgccctttgcasaataatggttttgaatacataaaacgcacgggatcacagaggaaaccaatcatattaaaatacagttgtcaaaatattaactcatgggatctagtaacaaatgttcttccttcttaacccattaaagaacacagctcatggtcggtccattaactactaattatcaaaacagtgggtgaaaacgatgtttggaaatagctgcgactctcgcgtgatasgaaaatatctgtgatttcgattgcgacaaacacacagatgcttctcacacgatcgcagtgcattgcctaaatgacagtaatgctaaactccagtcagatgttagtgaaaaataaagatgtaacattttggccatctgtgtacaccccctctttctagggttccagccacagaccctcagattaaggagtctgcactagcttgtagcttgttcaatcacacatacacacaaaaagtgccagttataaaggagcaggaggttttctggagccaggatgagctgggaccaacaccagcaactgtatcacccagttcactgagagttaaaatcacccatgtgacgttctctctgcaggcacatagtaagtgctggataaatgatagggattgatattgaccagctttgacacatgaataggagagggttaggcaaagacaaagagagatggggatgccaagtaccctctgggcagaggaaaccatgagtgcagaggcacgtaggcctgaaacaggccagaaagcaccaagcaatttgcttttgctggtgaaggaggtataaaaggtagagttgcaaagactggggatggagctttaggctgggatcagcgcccaatgggctgggatgacaagtgcttggggcacattggcagctgcgaaaagctcgctctgatgcctgtgtggggacagattttgggggcaagaggactctccagcaatctgtggcaaaaaaaaaaaaaaaaaaaaaagtcccgcttgttatcaagcctactggcttatctgttatttcttggacatgccccagtcgctagtaaataaagctgtctactttacattttgtctctgtgcccttttacagccttttctcggaggagctgagtcccattatattccgaaagcatatgttcccgatgattgctcattctctttccaataatatctttgcaggacaaagaggaatggggaagggaacatacttttaggatgtcagtcccagttttaattacaagtgttcctggttgtggcattcatgtaattgggggctgatttatgccaaatgatatgcactgatgtaaggggctggagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagtgctttatagacctctgatcagcttccagcatcctcttggtatgagttctagggggagatgaggaatgtgcctaattcccttgagtgatttacttggtgttaccctggagttgtgaggacaaaaggatggggctgactgagactggggatgttcatcacaaagtgttcaggttacatccaggctgattactggccaggagactaggcattcatagtggggcgtcctttaaggtctgaagaggacagtgaccatccaccacaggcaaacatgtgtgtgttaaaaaggaatgrcgttttggtctgtgctacaactgggatgaacctcaaacattacgctggacgtggtggcttacacctgtaatcccagcactttgggaggctgaggcaggtagatcacctgaggtctcagaagttcgagaccagcctggctggtggtgataccccatctctactaaaatatggtgataccccatctctactaaaaatacaaaaaaaaaaaaaaattagccagacatggtggtgcaggcctgtaatcccagctactcgggaggctgaggcaggagaatcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagacagaaagcaagctagtgattgcagggggctgggaaagaggggactagagaatgactgctaaagcattcaaggtttcttttggggttggttaaatggtctagaattagatcgtgttgatggttgtacaaccttgtaaatatactaaaaaccactgaactgtacactttaagtgggtgaattttattttatgtcttatttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggagttttgctctgttgcccaggctggagtgcagtggtgctatctcagctcactgcaagctccgcctcccaggttcacgccattctcctgcctcagcctcccgagtagctgggactacaggcacccaccaccatgcctggctaattttttgtatttttttagtagagacggggtttcaccatgttagccaggatggtcttcatctcctgacctcgcgatctgcccacctcggcctcccaaagtgctgggattacaggcatgagccaccaygcctggccctgatttttaaatttttcatggagacagggtctcaccttgttttccaagctgatctcaaaatcctggcctcaagcaatcctctcctctgcctcagaaagtgctgggattacaggcgtgagccaccacacctggccgctggaaatacatttctaaagaggaatgggagtcaggctggtgaagaaacacgtgagtgtgggatgaggatggggacacagagtgatgtgaggcctacacaacaggagttcaatcctaggacctgagctgatgtaaatgaagcaccgccaggcccagttggggaggaccttgtgttcctgctggagagtgagagtccctccctccccattccactcccaagagcagtgaagagycaggaaggtgggcttgttttgttttgttwtgttttgttttgcttgttgagcaagggaatgcggttcccctgtgtcggacttgtttcagaaagacaatgtcactgaggctggggcagggagattagstgagaggctcttgcagttatctgggaaggagctgtccataaaggcctgagttaagacagtagccctttgggttcgatttagtggtggctccccaaaagatatgttcactggaacctagacatttgagaaaaagggtctttgcagataagttcagttgaggatctcaaaacgaggtcatcttgggtggaccctaaatccaatgacaggtgttttcagcagagacagaagtgaagaaggcacagaagagaaggcggtgtgaaggtagagactgagatcggagtgattcccccacaagccagggagcactgagggctgctggcacccccagataccaggagaggggcacaaataggttctcctcagagcccccagaaggaactaagccttctcacacctagactttagacttctggcctccagaatactaagaaaataaatttctattgttttaagctaccacacagatgcaggaaactaatataccctttaatgattttctccatggcctttctgataatcctttcatccttcatctcccctgtygccsttttctttgctttgcttgcttgcttgttttttttttttttttgagacggagttttgctcttgtcgcctaggctggagtgcaacggcacaatcttggttcactgcagcctccgcctcctgggttcaagtgattctcctgcctcaccctcccgagtagctgggataataggtgcctatcaccacgccgagctaatgtttttggatttttagtagagatgggttttmgccatgttgtgcaggctggtctcaaattcctggtcccaggcgatctgcctgtcttggcctcccaaaatgctgggattacaggcatgagtccccatgcccagcccctgttgcccttttcaaaacactaagtgcatcatgttaaccttccactcgcttctttaagtttcctcactccttttaggtgaacaacccaaaccctcatatgccctagaggcccttttcagccctgttgacacttcccttctctgtgctttagtcaccctaccctcggtcaactcctaactcctgcctgccacagggcctttgcacatcctctgccggggaggctctcccttcaccttcattaggttatcagatctcagctcacacatcacatcttctgagataccttccagactcccctggccacggtcacttcctttgctgtggactctctgggaactgtgtccccttccttctcacatcagcttgcagttctgtacttgttcatgtgatcattgatcagggtccattttctgctccagacaatgatctctatctagaaagaatcatgcctgcttttctgcactctcctgcctctaggggagagaacacagagcctggcatgtggtagactctttttttttttttttttttttgagatggagtctccctctgtcgcctaggctgcagtgcagtggcgcgatctcagctcactgcaacctccgcctcccgggttcacaccattttcctgcctcagcstcccaagtagctgggagtacaggcgactgccaccacgcccggctaatttttttttttttttttttggtatttttaatagagacggggtttcaccatgttagccaggatggtctcaatctcctgaccttgtgatctgcccacctcagcctcccaaagtgctgggattacaggtgtgagccaccacgcctgggcggcacgtggtagactcttaatgaatttttgctgaatactgagtaaataaagaaaagttaacacagtggagtccaggtacagtggctcatgcctgtaatcccagcactttgggaggtcaaggcaggagratcacgtgagcccagcagttcaagaccagccttggcaacatggtgagaccccatctctacaaaaaataaaataattagctgggcatggtggtacatgcctgtagtcccagctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccrttctggagagcctttgattataacatcagcctgtcatttggacctctgacctgaattatatgaatctgaaaaatctcttcctttcctatcgtgarttcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcgggatggtttttgtggttgcctagtgtcttctaaagacccctgaacatagcatagaaacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccrcgcccgrctgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactgaagagttgataaaaaagcacaaattgtaggctgcaaatctatcatttttctttcctccttcttcctctccctccctcccatcctttcttgctttcttccctcctctctccttccttccctccctttccagcttaactaaaattttctgatacttttttcctgaattagggtatgttttggggggaaaaaacgcttcagtgcgtgtttctttcgacattacacataagcccccatggaaagcaaattgaataaatttactctctaaacttctttccacaagagtaggtttataatttattttctttacattatctggataattacatttggtttgcttacatagatggaggcgaatggttttccratcttcaaaccaacctatatcacaaaagcattctgaaaactgggaagagatcacttcacagtttcctgaaccactagaaaaaaaaaatgttcataaatttatagccgctgacattgaagttggagaaaagagcatatctagyacctatgctatgtggagaacactctccatgtctttgaaaaataagcacaatacaaattatatttgaggatgacctgccaaagggttgattatcctggaaacatgttttctcaatggtccatttgggcaaacaggccagctgaggtatctcaggatagcaacaggataagcagaatcgattgatgaaggagggagcctacctctggaggccccaggctgggactttgggtacagatgcacaggagacctttgccccaccccgtcacggctgggcctactcagttccacgtctttgagktttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggaytttggaaatggaacaggatgctcctttaagttagggtaaaatgaagtctataaaaactgtttttctatatcctcctcctaccccacaaagaaagttagggtaatatattcttatataaaattgacatttttaactttaatgagaaattgcttgtcctttaaactttaggcattgatgcgcttaattatgcttttcaacaagattttgcatttttaatatttccttttagagcttccaggaatctcaattattaattgtaccstggatttattggtctttggactctcccgctagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatgagctctggtttaccccatagtccaaataaagaatggtttctgacattgtatgaccaaaaaaaatagcatctgcccaaaagatgctatttataaaactgttacaaatggagcttattgttcaccagaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggwttctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagrggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatrtaatctatatattgatatctatataatatatataatctatatatgatatatatatcttattatatattatatatatagatagatatctatatacagatatctrtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaayatatatattatatatatataaaatatatattakgtatagataatttatatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatatagactctaatatgtagtctatatattatattataatgtatgtaatatataatatattctatgtaatatataatatattctatgtaatatatattaatatgtagggaatatgttacatattatgttgagagtgtatatrttatatatgggtttctatatattataataaacccatatataatatacataatagactatacacatatacagctaatatatatacacaatagtctagtatatattatacatgtaatatactttccatacatacatatataatttggggggcaaaaacatatatataatgaatataattatataattcatataatatatgtaatagagcgtgtatattatttacatatgtatatatatatatatacacacacacacacacatttcaactttcttgaactcctgaaccagccttagattgcctagtaccagggttcttctttttttaaaaaatttatattttattttaagttcaggggtccatgtgcaggtttgttatataggtaaactggcgtgatgggggtttgttgtacagatgatttcatcacccaggtattaagcmtagtgcccattagttatttttcctgctcttctccctcctgccaccctccaccctttggtaggccccagtgtcttttgttcccctctttgtgtctatgtgctctcatcatttagttcccacttataagtgagaacatatggtatttgcattttctgttattgaattaatttgctaaggataatggcctccagctccatccatgttcctgcaaaggacatgatctcattattttttaaggctgcatagtattccacggtgtagatgtaatatatatataatatatatataaaatatatattatgtatagataatttatatataaatatgtgtatatatatatttgttagggtaaaacaaagtctataaaaactgttttcctttgttattgcccccaccaaatatttatatatatatacacacctatgtatatatgtatgtatagagagtctattatatatattacatatacataatatatacataatatataatagactctataatatagactctaataattattttttaaggctgcatagtattccatggtgtagatgtaccacattttctttatccagaataaactattttttatactggttttaggctcacagcaaaatcgagtggaaggtacagggattttccagatttcccctggccctcactaccacatgcgtagccacccctttatcaacatcatgttaactattttaaagtggacagttgagtggctttaagggcattcatattgttgtgctaacatcatgaccatccatctccagaatgattttcatcgtgcaaaactgaaacgctgtacccacagaacactggctcctcatcacctccccaagcccagcccctggcarccaccattctcccctactttgtctatgaattcgactactcttggtacctyatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataaatgaaaagcaccattattagtaatgtcaataactttcctgacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgccccctcaccgaatgatcaggagactggcttccccaatgccctgggcttaattcccagatatttattctgttgtggagtgattatctgttcctggattgtctcaaaggcattaatctttttggtatccaacatcttgaatgcttctgtgtcattttcctttctttttttttttcaaagcacttaattatttaaaaacaaaaatmcttctctgatcagagcatacctgccgtgctcaaagcacttgcttacttggaatgccataaattacatgaaggaattattcattgtatcacgaaacataccttccagtctcccgagtagtstattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaaaaaataaatatctgtgatctcatcrtttgaccgtcagtattttcatttttgcatgtgccactttaatttccctaggcaacactagctagtggcccacaataagacgtagaaaacaagaccacgtaccttccagaatcattggccctggctctactcctggaaacccagtccatctctaatccctttgatttccaatgggaggcaaatccaggggagttctagactgtckagaatattgtaccaagaacaaaaggccaaccccattagacagtggccaagggaggtgaactaaagttggtgctgtgaacagggctaatggtttgtgatttacccataagtggaaggtrtactccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgayctcaggtgtwccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagstcctaaggaagtgccagagtcagggctttcctctgcctgaattatcggagctcttggcttaatgtgggagaagagatgaatgatctgtccttctatgaaaggcttaccaactccattcaattcacagtggctctctgaagctctgtttttggaaggactgtgaggctgtacctgcacttgattgaacgagtgctgggattgattagtgatgtctgcagtgagcgaaggattgggaagagtaaacaggcatgctgcatatctgtcatcatggctctgagtgtatcctgtttcagaagagatgaactgtgctgtagagatgttagcatcaggtattttagacacatgaagagaggatcagattcagtggaagtgccaaagggattctttcagatgggcaataagtggttctgaagatacgtatttctcagtgtgttatcttggctccatttagccacacaaaaggaatatgggtatagtgatgggtctctcatggctcacgtattaactgtatttgttgttactgcttctcaggcactctgttaagaatgcagggctcttcctcagactcagsgcggggcctgggctttacagcaatggttttcagtttgtaatctctctcaaggaagggagaggagcacaaagctgccttgactgccagcaccatcagaaaagtgacagcagtcttggccctgtaattgccaacagtaattcatttgttcgttctctctctctcgctcctgctcctgactctgggggatgcttcttttcctaccctgcctggaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcasctcacaccctgttggccctttgcaaatatttgtctttcctcatgcacgtgkttattcccagaaagatccagtgaattgtctcctgaagawaaaatacataaaagggcgtttcaaagtataaacagtgattttaatgaaaaataagaagaaaatgcttatgatacaacattaggtggaaaacgaaggaagaaaaattctgtgagtctaattatggaaaaaattactaagatatgttttaacatgccctagacatgcacagaaaaaaaagactggaaggaaatttattgagatgttattgtttatgagtgttctaattatgatttttaacaatatattatcagagttttctgacaaagaattaactttttattttttttgagacagagtttctctcttgtcacacaggctggagtgcaatggtgcaatctcagctcactgcaatgtctgcctcccagattcaagcaattttcctgcctcaggctcccaagtagctgggattrcaggcacccaccaccacacccaactaatttttgtgtttttagtagagacagggtttcaccatattggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattgagttgcccctaggatcatttttttcaaagctaatgtctgccacaaatgggagttttaataggttataattcatatgacttagtgttaaacctctacgttggkattcttaaatttaacatggataaactgaacttgatttcctgcattaaaaaaaattaaagaaatgaaagttctgactgttttattgtagctggggaattctttttgcaggtgaygctcatgttacggttttgaacccaggactttgcgttgcagttttgttcaggggttgcagaataccgatctgactttgcaggaatgactgtcttggtgcataagccattaacctctctgcgcccttggattgcctcctctcctgccagcagaagccaagtcacctcatctgtaagggagtttcattgaggactaagtgggaccaggccgaaaacgacccccttcccccataggaagtcacagaacagccaagccctggaacaggaggagcagcttcctcctgggcacagctgtgcagaaccagaggcgacgcatttgcccatcgtaaaggctgattagaaacagttgggtcccaagcagaatccttttgcccatgactgtgtccatggtcgaggtgtccattgtcactgttgccagatgccagcactggcgagggttttgccttcctaccgtaggcttcttgacccggcacctcggaaagtaactcctgtccattgttccttgtgccatctttcttaagaaaacatgaggaggagcagggtgatgctagatggaagcaggagagcctggggtcttagtttcagtggctctgacttcagttttctcacctcgaaatctcccttctctgaacctttttgcgtgctcttctgtctgtctgatattcatcatctgactcatctctaccagtcaggagttgcttcttccaggaagccacattccatggactgatacgctgggctccatgccatcctggggttctcttgagtacatctggaggggtgtagtgtgttgtaaatgcatacgatcatgctggtacatttcatcaaaggtggcagttacactaccagttgtgtgcccttgggcaattagcatcaccctgctgtgcctcagtgtttccatctataaactgggtataataatcattcctaccccataggttgctgtgaagattggctcacatcagtmatgtacttggaatggatcctggcataaaaagagcccttggaaaatgatagcgttcatccttggtatgacctccaagttctttgaacctcaaagagccaagtcccacatctcaggtacatttcagttcattctttctgagttgatttttttttttttttttgagacaaggtctcattctgttgcccagactggagtgcggtggtgcgatctcagctcactgccacctctgcctcccaggcccaagcgatcctsctgcctcagcctcatgagcagctgggaccacaggatgcaccaccatggccagataattgttttgcatctttggtagagacaagscttcactatgttgcccaggctggtctcgaactcctgagctcaggtgatctacctaccttggccccacaaagtgctgggcttacaggtatsagccactgggcctggcctgagttgataatttttrtcatttmtttctyacttttctcaggaaaatcatgactgtaaaacagatcagttttgctttagttcccaccctcatcatcaacccctccccagctaccctgcaaaagagtcacagatcattgggataactagaaccacagagatccccctagacttgtcagccagggaacctgacactcttagaccttcttctgagtgctttgtccttgtccggagagctcggggaggagcaaggttgtactgggatttttttccgatcacagaaagtaacttagctagctgttgcccagccaatttgcccaagggagaggttgctcctgggttgcaggacgcatccatggatggagcatgggttttgggctgtggggggacaatgaggtggttcctgaaatccctagttactagcagacaagtgcatcagacaagtgcatttcaccgttctgagcttcagtctcttatccaagcagaaacatggccagaatgcaatgtcctaatacatgtaattcattacgtgtgttgtcatgtaatgtaacacacctattggcagtctctgacacaatacagatattgaccccatggtcttgccccaacttaaataaaaataaaaacgaatgcaaaagaggaatcttctttgcactcgtgtgatgtctgttaattcttggctttcttccttcataaggttaatcatctccctgtcacccctcccgcttgtcccccagcctctgtgtgtcaccttctctctgagctcaccctctctaggaagccttccttgctggaatgcccattccctgatataaggattccacccaccacgccccttgcrgttccttgccggtgtcctgtcctgggcagacataagccctgtgggttccagtttctcattaggaacctggatgatggagcagggatcatgctcattaagtccgcagaactcatcagctgcttagcagggggccaaggagggctgagcctatgacgggtgaataagtctggttggcctctgggagtacgggatcagaattccaagtgactggggtcagtagcaggccaccaagagccatcccacctcagaaagacagaagccatcactgcaaatggcaagggcatgaggcagtttgaaactggcaaaactggasctttcatggaatccagggcttgagctttaatgctttacacttttgttttttcattccatacgcttttgctttagcttcctggcaaaattcagacaaacctagaagggataataacttacattcaacctctgcttgctctgtcctttctcacacgtgtttagagaaactggaggagcccgggaactgctttctcctctctaagagtcttggtggtttcttgtgtggaaatgaatgggaagttcaccctggttctgcaaaatggktgcgaaatgtaaaatgtatataccttctatcctactctttatgttccacaaattttggagggaaactgattaactctctagctaccatgttccaggtgcctgcacctgcttgctcttggttaacctgcacccacgttcccccgcctgtctctgaagtattcacaggtggaggctcagatgcacacagtgattgagtgccctagctggggttggaaactctgtccatgaactccaaagcccacgctctcttacaccctcccaaaagctgaggcttcctcactgtcttttgcattatgtcatgggtggaaacatgcaccttccctgaccttttggcttggaacatggaagttcattgactttgttgcctagcagggcctggagctgggtttcttgcctgatcaatgtatatcattttgccaagagacagagtctgtgctggagagattgattccctggttatttatcttcctctgcccagtgtaaattggtcagcctgatcctattcgcatgataaaaatcataatgtctcaaattacttactcaataaaatgtgggtttgtctattattagtgattattagggttataatgcagcrtggaaatttggagcaaattaactatacatgcaagctgttgggctcaagtgcagttaatcatacgcatacagtgccagtgggcagaaggttttgcaagaatagcttcaggaagactttgtgggaagacagatgaatactcagggttttttttttttttttttttcttctaayttgtcctccttgatcaggatttctcaaatgcacatttgtctaatatactgttgaaccrtgcaagtaccaaaacaaaacaagaaacccagaattatagctcaaatttaattaaaatagcttttattgcttctattcatgtgtccctggattttaagtgatgcrtcagaatttcatgatgagcaaatgcctrtggatgccctcatttctcatccttcttgactgtctgctaagattcactcttggtcttgtctttgagcttttctgttcagtgatgtaatgggacaggctctcctgtcatcaagagttcccatcatacctgggcactgccatttcctctgtggtagatgcttcctggacacgtgggcaggtgagaggtgctgactttgcctacttgcagctgaagagaagagagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggrttaaaaaaatggtttttgatttatgaaaaatttttctgcaggaaattttgatttgttctttgtggattctgaggataaaattaagaccaacattgaggatgagagacagaactgaactcaacttaaaatagcttcagggaggaaaagcaagtgcattagataagtaagtgggaagtccaggggtagacgtgagttcaggcatagctggatccaggatccgacagcttgcatgtgtagttaatttgttccaaatttccatmctgcattataaccctaatgtttgctaataacacacaaacccacattttattaagtaagtartttgagacatgatgatttttgtcatgtaaataggatcaggctgaccagtatagactgggcagaggaagattcataaccagggaattaatctctggatccaggctgaaatgatattatcagacacctttctttctctggtcctcagttttgatctcttctctgctagctttattctaagacaggcttagatgggatgtagagagcaaactctggaagtggagtacctctggcctccaaggccagtagttgtagcaaaagtccagggctgccgctcattcactctgctcggacctttctggtcacttgtcttctgtggtttggtccttgtggccagggacaatgaaactctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggyggtctgatayagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcccagcgctgccacttaacagctctgtgaccctgtaaagtcactcagcctcattgagtcccccatcctcccctgtgyagaatgaggctaatgctagtgctcatttcatagagttgctacaataatcaatgagataatgtgcataaagatttacatacataataactgctcaataaagggtagatgttaaaattagcatcagcgagctctagaagatgctaagttctctggaaagatcagctctgctcctgtcaatctctccaaatgttagattttgcctcaaattttaggcattcgttcattcatttattctttcgtaaattctatcgcattaacctttacaagtgttaaattaaatcttttccccaaattatgcattagaaccaagttcttatgtggtggatgtacctcatttcagcaagagctttctaagggtacagaattaaatatgcagcctctgggattcagtgatagctcatgggacatttgacctacatggaaatgcaggctggagttgcattttaattggcaaggatcagcccagttgtccagcttgtagcttggagtgtggcctggctcccactccagagagatgtacatcatgatctgcgtgggtgagaggatactctcaggaaatgggcaaagttgccagctgacctctccagaaagagagactatgttgttagtttcccttacttggatgagaaatttctccattcctagtctcattttcccaatagaacacggaggcagaatttaaagcctcaaaacaatctgatgcacatcagctatcaatgaaaaggaccagcttggaggcagaggcacctgagttttgcatcttggctcaatcacttactaactgcattgtgggttaacacagtgtgtgtgtgtgcacttactaactgtgcaactgtgggcaagtgatgtaatctctctggagctcgtytttccttttttcttttcctttttttttttttttttttttttttttttttttgagatggagtctcactctgttgcccaggctggagtgcagtggcrcaatctcagctcactgcaacctctgcctcccgggttcaagtgattctcctgcctcagcctcccaagtagctgggactacaggtgcacaccaccatggctggctaatttttgtatttttagtagagacgggctttcaccatgttggccaggctggcctcgagctcctgacctcagatgatctgtctgccttgccctcccaaagtgctagaattacaggcataagccactgcacccggccacagttttcttttctatattgtagggataataatcctcccttgcaggactgtgctcagcacatgttcattgctcaagagaagtagccactgttattattattgtcagtatgtatccaagtgtttagttcattttctctgcatttgtctaactcccttttttcccttgaactgtaaagctctcagcccagggatatagtagcaccagcacatagtagatgatcaagaaaaattagtcattctctctggttcttcctttcctgtatcctgttgtctttatcagttcaggctgctgtgacaaaagtatcacagactggatggccttaaccacaattgttttacatggttctggagactgggaagtctaagattaaggcagtggaaggttcactgtctggtgaaggctgggctcctgattcatagatgtctgcccttcttgtgcatcttcacatggtgggaagagggtgagagagctcaccggggagtgtttctcccagttcctccccagtacacagaaaaacaaagctttctgtctcaccaggaggactccacggtgagcatagcttggctcmgcccagcaggagattttgaaccgactctggtagattcttcctgcagccattcagctcccacctctttctctcaaaaagaaatccagggctgggtgtgtgtgggcaacttcaccctgctctctttgtcccccaggcctgcactacaacaaatgtctctttgtgtccaactcttcttccatttctagtccttcttttctcttcttctcgtacttcccatattcctaatacgattggttactcaaattcttaaacaactcacaactcattatctcccttccatgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaaragacacaaattgtccttaccctcatggattcaccatstatttaamggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgtatcagtgtcctgtggctgctgtaacagattactacaaattttgtggcataaaataacacaaatcgattcccttacagttctggatgtcagaactgggtgactttctcctgagactgtcctgattttttttttttttttttttttttttttttgcttgtcagtttgttttgggtgatgcagatggaaggtaacgtcacagggcagctgtattccaggtacttggtgactcttggttgcgatctgatgactggctcacagtaggaccatgacgtgagcagatttgtagtcctgcatraatgaaggaaagaaagaaatctgacaactcattgattcagattcacagactctgcattttgaaccagaatacacccgagcaattacctagcacaaaatctcctgtctgcagaggagttgcaggaaggagaattcactatatcctctcctgaaaatatcccttgtggtcaaggtggctatagactggcatccctctgctccctaagatgccagggactcacgtcttctaggatatcaggggaagatacagggcaatgggcctcagatcacagacacggaaaatcattttctatttcatggagcatggagaagcttccttcaaaaagctagccttcgactttctattttttgaactgaagggcaggccaggagggagctgacctgtgtagagcttggaggttgtgttttcagctgagaaaagtgatcctgaacctctccatccttgcaaagctcagatggaagcccaggggccccagccctccagccccacacacatgccggtgcacctggactgccactctacctgtttacaaattacccccattttctgcttggttcagcagcaactgattaccgtcccccgtgatgtaattagggcttcagagttcacgtgtgtctattatgagctctcctgtgctttgtcttggtgcttcgtttctgtagcagtaatcatatatatatataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctgcagcagatgcagacccagcactccggctgctgccagtggaggcaggagcctcgttaccacctttctgagaaattcaagtgccacacagtggtcaccagcattgtagctgccctgatgttccgggctcagctgcaatatagcacatctctaccaccatccccagagtgacctccagaactgtaagggacccccgcctttggtacagagatgggagttaaacacaggtgtccactggagtcatgattcctctattccctggacaaatatgcaatgagaatccctgagggacaggcactgtgctagatacccgagatacaaaagcgacaaggtttctatcctctgacagtttatactttagtgcagtggtcagcagactgtttctgcaaacagctagatagcaaatattttagactttgtgacccatacagtcaccatcacaactattcagttctgccagtgtaactcaaaagcagccatggctgttacataatgagtggctgtggctgtgtgccaattaaactttatttacaaaaacaagaggagggccagattttgcctttgtcaaggaagtaagcataatagtgcaagcagcacgtgcccgctctttcacactggggcaaacacaggggatttattcggcacaattgagtaatgtggatgaggctgctcagggctggcagttgtaggacgcaaaaccttgaggggcatcgatattctggtacagctgtcacccatttgcagcacagctgggacactccacagagaatgatcaggaaggccaagcccagatggcattgttgaggggctttctcttaagactgcatctgagtggcagggcgcagtagctgacccttgtaatcccagcactttgggaggccgaggtgggtggatcacgaggtcaggagttcaagaccagcctggccatgatggcgaaaccccgtctctactaaaaatacaaaaattagcctggcgtggtggccggcgcctgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatggagtggtaaaagcatgtggttccattaagggaaagactccagggcaagaaaaaaacatgtcatgcttgtacctgagggaaggccagtgtgattgcagagtatggggcaccctggaggtctggaatgggaggagtttaaacaggtcattagagcttcaagatgaagcataggccagtgacttggttgctgctgctgcgtaaccgtgtggcaactgagtggctcacggcaatcagtatttacttctcacgtgtgtgtggggttcagcagaactaggctgggcttggctgccctgccctactggtcctgctggttttggtggggcttccccctgtgtctgtgggtcagcttgttttgctcctgcatctttgcatcagctgggctttctgccctaggctggacatgggtggggcactttagctggggtggttctcctccacatgtstctcatcttcctgggaccagcagggctagaccagacatgactttcttatggcaagggcagaaatgcaagacagcaactcaaaacacataaggactttcaagtctagacccagaactggcatacccattcctctgtcacacactgatgccccaaataaatcacatggctgagctcacggttagagagggaggatactgcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaattcaggaacccaggctccttccattctgtggcttcaccttgaccaacgaagaccttttgaggttgccacattctccaggccactaacacttatgtcattggctacaactcagtcacatgaccatggctgcctgcaagggaggctgggaaatatagtttgctgtgtgctgggtgggtgggagggagcgtcmacattagtgaacagccaggcagtcgctgcctcamatttctttagkgttatcctttcatkccagcaattgaatttgatttgcactgtttcacttctctacaagggtgtaaaaagtagaggttcctcttgaaagaatttcctccccatctaattaggaataaatagtaacttctcttagaagcaaagttaattcaaagacctgtgctaacattcttaaatatctgctagctgtaatgaagaaatcaatgtactttatgttcttagctcccacagtttagcctaaatatttgccctggcatgcttatactggtccaagcaagcattaggtcatagcctgttcctcttccttatttgaaggtgtttttacctttctcagcattccacaagttacttcgtccttcctttgttctcctctgcctttgcctcttttttctttttttattttaattttttttttttaattatastttaagttttagggtacatgtgcacgttgtgcaggttagttacatatgtatacatgtgccatgctggtgcgctgcacccactaactcgtcatctagcattaggtatatctcccaatgctatccctcccccttccccccaccccaccacagtccccagagtgtgatattccccttcctgtgtccatgtgatctcattgttcagttgtcacctatgagtgagaatatgcgttgtttggtgttttgttcttgcgatagtttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacrtatgtttattgcggcattattcacaatagcaaagacttggaaccaacccaaatgtccaacagtgrtagactggattaagaaaatgtggcctttgcctcttttaaaaagttctaagttgctagccagtcggracaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagyatttctaacaatcatattgcttaagaagtggatggcargaagataattactaatatgtctgcaattgatctgaaattgacacagttgatctawctgattcatggggaccctgggagtatgtttgtgtatttgggggttgggatgggggggtgggtggagggtcagagaggtggcaaaagcrggtgggaacagggttacagagcaaagtaattagatgccctttagatgctcttagttaaagaccatgcaaaaaggatgaaatcttttgatcatgttcttyacaatattagaggtaaaacatgaactcaacgcttttaggaaraaacaactggattgcgttttctattttattgacagaaactagatggggaggccagggtgtgttttattattgcacacatacgtaattacaaagtctttgcttttttcccctacataaatttattttgagatttaatttccaccaattagaacccgaatgaagccgttttaatgtgattcctgcatcccagcaacgtggccctgcttcttagtgcgcacgtaaagaaacaatcctggagtgaattttaagtacctaaagttgtgttagactgcaaatgaatatccaattcaatttgtaggaaactttagattaattaggtttataatttgcacagtaaggtaatgtaaatgtgttgctacggcttgactttttgcttaatcctctgagtggatatttaatctttttaatattagaattaaagcaacttggaagatatgaatattaatctaattatattccgatcactttaatttctttaatgttttaaataacaaaacaactttacaaattggtttaggttggggaacgcttttagaggattttgcatctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggyaggaagagtttgccagcccgaaaactccagtaagcaaacagctttatagyaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggctgtggttaggctgacataattrtgagctgcatgtaccaatatatagctctttacccacaaaagcatgctgcaacggggaatctttcagagataataaaaggattcatcaagtgtctatacgatagctacttaaatcgctattgttttagttaggcccgcaaaacatatcccccagctatcccggtttcttatctttcttacttgatatttcaggaatttcaagcttttgtacagcttgttcagttgcatcctagaggaggaaaatgcttttggcgtgatttccatttcaagatgacaacagggagaagtctttccaaaatgcgcgtgttgcaatttcagatttaatcaggggaatacattaatttctggaactaattacagattttaaaagagtgatgggtctggtacagtggctcacacctgtaatctccacacttggggcggtcaaggtgggaagatcccttgagtccaggagttcaggaccatcctgggcaacatagtgagaccttgtctctatgaaaaaatgaaaaataattagccaggcgtggtgtcgtgtgtctgtaagtcctagctactcaggaaggtgaggcgagaggattgtttgagcccaggaggtggaggctgctgtgaactgtgatcacaccaccgcactccagcctggatgaaagagtatgacctttgtctcaaaacaaacaaagaaaaatcataaaagggaggcagaaaattaactgaagaaattgtgttataaaaggcagtgttttaagttctagaattaaaagcaattgcagcaaataccaagtgagattttctgtattttgagagtttgtgtgtgcaatggttttccactgactaatcaggctgataaaacaacctgaaaatggctttcccatggagtttatatatttcgtcagagacctaaaatggtataaatgttcaataatagccagtgaatataaaactaaataatccatatgagacaaaacaggtagaagaaaaaaacattcctcctcagatatgcaccttttaattgaataaagcaaacagtaacagtgattaccaggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcagaaagaagttacttcccattccccacctcaaggccctgtccaaactgaagattcatgggcagaataaacaattgctattttttaaaggtgtatgtttggggttgtttcctacagagcaatgaataaccagagcaaacacccaagggcaataaattatgaatagtgaatttaatttttctatgtgacctatggaatcagcctattttatggcagtacaaagtatatgtagcaaccaaacagtttcttctttcctaaaactcaaagtgagtcagacttcttaggcttgtagatgttgaggactaagctttgctctttatmttctctttatggatttccctttggaagcagggataagaagagrgaaggtctcccagatgtaaatttctcataaatatttgagctccatttcagtaattcyttcattctctgatctgttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagtaataggctgtcactagaccaaaaaaaaaaaaaaaaaaattcagcatttcttttcattggaggttaccccagaacacttaaactttggagaggaaaatagaacccctgaagaaaagtgaattctcatgacaatttgtacattctttgaagaatgactgtaatacatggaggagttaccttggacccatgtgcagagtagtgtcgtgaatgaggcctgtgccttgtcctgtggtttaaggataggtaaatgtatctggggcagagggttgcctgggacaaaggcattataagcttattcatttaacttgagtacagggtttctcaagctttggcactgccaacatgtggggttggataattttttgttgggatctgccctgtgcattgtaggatgtttagcagcatccctggcctctacccactagatgccagtagcatcccttccccctcttgtcacaaacacaaatgtctccaaacattgccaatccccctccattaagggtcatgtctcttggctgggataagtcttctctaccgtatccctttaactcaagaagtttttcttgctaagtttatgtgatcttgaaaatacggtgagattgaacttgattttctttaaaggacaaatatctgcttcttccaaattgtcataggaatagttcaaagctaaagagcctttcaggcaggctgggcacttcaaacctacaaaacatagtgctaaaattaaggagtgtatagtcgtgtgtttatagggacaggatatttattatctatcacttttgaaaatgtcattggcattatcgttcacttttacaaatacgaaggaaaaatatgaaggagttctagaaaacaccagaagtgattttgccgccatgggcctgaattgaagagcttaacccactaatctgttatgactgcttggggagtgctagcgcaggttctctaacacactgagagtcgtttggagggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcktgtgataggttcaattctcaggctccttctcrtyagagtctttctgtaaagaccattattattkctgttatatttcctgtggctgagctgagccgcacttggagatttgatccattttaactctctcattgccttcagagagttggtgattttggggggggcaccagtktgagtcctttgatccttgaatgacaatttggatttgtctcaaggtcctgmtaaatgggaactggaggaactggcctactatggtattacaggctagcacatggtttgcattctgagggagctcagaataggcaaggtagaagacataggtggtcaagaatttagaaagacccggactcgaatcccagctctgatccatctcagctctgccatattgccaagttccgctgagrctccatttactcacctgttgtatcatctgaattatttycatatccataatgtgcaaggatatccttccatgttattagaaatacagatacaccatcattatcastggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaamaamaaacaaacaacaaaaaaaaactccttcttcatttgttatagttccaggatagagtgtgtacctgkatagagagagtcaggcagatayaggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatrcttttgaattgtgtgattattgttgttaccatttattraaagggaatgatgaatgtagtgagagaaggaaggaagagagagagggaagaaggggaaaaagagggatggaaaggaggaaggaaggaaaggagggaggaggcaagtatawtagtcatgatatakggaattgaaaagacattcacrttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgaytattatasagatttatggcttcttgtcaataatactctgatttctggagattgttatcagtcataagctttataggaaatatctcctwttgamaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaatatgggtgtgatcttgacattgagatgtagagcttgacacctgcatataaagtagaaactcaacagtgtttgagaatttgccattgcatctcagtcttttttatttatatgttttttctttttttgagatggagtcttgccctgttgccctggctggagtgcaatggcgcgatctcggctcactgcagcctccgccttccgggttcaagtgatgctcctgcctcagcctgcctcccaagtagctgggattataggcgcatgccaccatgcccggctaattttttgtatttttagtagagatggggtttcactatgttggccaggcatctcaatcgttttactaagaaatttggaggccttgagaaatgggtaaacttgaaacatttaaaaaagttgttctgctaattatcctaccacgtgtgtcagagacaacattaccctcttattacttaaaagtaatttggactggttcgcacacacaaaaatagctttattaacaacttgagtaatttatcaagttcagattctttttttcctccagaaatgctgcttttggtacactgagaggtcattcatttaaagtttgtccttggcaattccttattgaatagattccattttattttatttacattttgtacaaagctgataaataactgaaaccaaattagctcaaactggttatatttctgggtacaaaccaggtgtatagttaatccattgttgtttctgtgtcraccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgcccgtgctttctgatgccactgaagatggatagaagcttcaagttatgctttgtgcagactgaatttttccaatttgtgcttagtagcatcttattatattagaccagcactgactggtgatgaatagcaagattgctcccttctaagggcttggcaaaccaagaagaatgcagtgacatatgtcttatgtcttcaaaagcaactggacacttgaagagtattttctagtctcattttgtaaacccaattacgagcggagctacaatttttatctttgtttaatgtaaccaatgaggccattgtcactgtatggagaatagctttagtccatattctctgttttttaagactctcagtctccttgcaggtgcctttggagagttaggtgtttgctgtgatttgagggatagtggccaataattttattgaaatgaatattggttaattaaagcttattgtatgccatgggccattctaagaacttccatccacccaaaagcactatgaaatagatgttgttatttcactgatggaaaaacaagcacagagaggctaaggaatatgctgaagcttgcacagctagtaaatggcagaacattcagactggaattcagacttatacactcacattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctmaaatgttargaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatacccattcaacaattagaagctgctgatttctggacgagagttagtttatttagaaagtaacactcagagacactgggacagagaacagatccattttaaggctgtgtgagcactgatccatgacagtattggttcaggggcaaagaatgggaggaaagaaaaagacaagttatagctgcactgaaaacaaactgggcatgtcctaattttgctcagggctacttctcttagagtcgttaaggttttgagcatattaacagcaatactgatcatagctaatatgcctctatgtcaggctctgtactgggttctttgagtatactcaccacctcctgacaaggttttggcagccttacttggtagacactatgattcccattacatacatggaatgtacagtaactgaggatcactgtgatattgggaaagtgggacttcagacgctagcctccccttgtagtgcctgcattcttttcacagcccctccccaccttagaatcattttcttcaagggagagtatggtttgtgatgcccttatcagcaaaacttcagctagaagatgcaagggtgaaatacacctccccaccccacgtgatctcatagcacagaatgactggccaccccagactgaaggttagggagactgggggccccagactcaaggttggggagactggggagagggaaagcgaggaagaagcgtaagtgtatcttacagtttaaaaccataatgggacatatcattttcttagttctccatttattaataaaatgcccaataccttctggcatgtgctttgaactgcttttaattatcttcagttggatggagaaaaggtaatggggacctcataatagtcgtggagggacaactgggatttatttccatagggaaggcagagactgtttgccagggaaccaaggcctttcaaagttgaggacacttcccggtgccgtgcggtgtaaatcacagtgcaaactatgcgattatcccctgcagaggaatcgastgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccmcttgaacagtgcttgagagtatttccattataaatgtcgaatcggcattgaaggaacatctgttttaagtcaacttagactcaatccaggaaaaaaaataaatttctggctgtccacctgctcaaaaggtcaattacccacccaaatcagccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaaaccaaatggagaattccaggagcggatttggaaacaaggttgggtctactttggcctttaagccatcactagaaacactgactcttgcgcgctagagtgatgtttttccttctcttttggattgacgtgccagcacctcaagaaacctctgtgaaaaatccacaggtcttcaagaaccagaagaaaacagaataaaaatagctcaaaataaaaatgaaaatgaaaatagagcaaacatccatttctgtgggacctaaagagttgggaaacctaaacaaccagatgatgatagctgttgctgctcttcctgaaatcaattttaaagtaggaattgtcaaagataatgagactagtatggagcaaaaactggcaattttcagttaaccagaatgttgcatgaattagaaccccagattttcctggagatgactctagccaggccatttgaggacaagttgccaaatatttgtattttagaagcctcagaagtgtgcacaattttctagttctcaacaaggcactacagcaacatgtctagtgtttatgtaaatgatctttataaatcctctagctgatagagagttttcttccatcacaggcaaaatgtgggtttagatgcaatttgtaatattgttgtacaagagtggggtcctttcactgacatatacgaagtgttgtaatacaaggcaaagaaaatacaaacccatccttagtcatttagaaagacaacctggttgagaatttaagatgatggtttagggcatagcttgtggaattcgatgggttgcactgtaagtttcagtttccttatctgtaaaagtaggaataatatctagacctaaaggttattttgaagattaaatgagataatgcgtgaaaagtgctgactcagcacctgcagaacccatgcgtcgtcatcatcacgtttgttgagggatttgaggcgtgtctaggaacgcagatgtggagacacctggagcatcttcaggagctgtttctgcggattctcatgtggcttatcaagcacaggaaatagttttcctggaaagacatggagcaaagcagttatttagccgtccatccggcactgccaacctcttcgtgttcctgcaaggattaaatgagagatggtgacagtagagagtcagccctgagggaggagtgtacaattcatgggctactattccatgtgtgtgggtcaggagacgcttaaggcattcacagcactgggtgtgaggaaggatgcaaataagcttaacttatttatgaattatctgccctggaatggcattctaatgttgtgttggaagagagacaagaatgtgctgggaggatactcagtttataacggacgttctgatggccagtgcaaatggcgccaggaatctgtgtttatagagatggagcatggatgcccctgagcacctgtgtgtgtgcgaagggtgaatgggttgctgggagttcgtcggttgtttagggaagcacttacgtgtatgcctgtgtgtgtctctaggactcactctccacttcccaccttacttattattagtgttcttgtttctcttcgctatggggaaatgcagataaaccgtaaaaacttgatagagtgaacaaaggcttcggaagcttccttagttcttataattgctcaatgggttcttcttgcctgctgcacaggtaaaacccagttcactgagatgacattatggcaggaaagaaagagtttaattaacacaagtccagccaagcaaaaggacaggagtttattattacccaaatcagcctccccgaaaatttggaggctagtgttcttccaggatagtttagcaggaagggagctagggaatggaaaatgctgattggttggggatgaaatcattgaagtgtggaaaatggtcctcgtgcactgggtcagcctcagttccagttgaatcacaagtcccaggcctaggtggggtcagtgggtcatcaaaatgcaaaagtctgaaaaccattccaaaaaaaccagtcttaggttctacaatagtgatgttatctacaggaataattggggaagttccaaatcttgtgacctcctatgcctacatcttagctgaattcagacccctctcctaatcctaaccttgtggccttttaggagctttacaaaggtggtttcatttcgggaaaggctgttatcattcttgctttaagattaaagtataaactaaattcttcccagtgttactttgccctatgcccagggatgagtgaggactgccagcccgtggggctagaagcaagatggagtcagctatgctgtcatattcctcttatggtcacaatttcacaaaggtggcttcattctcatgaccattgctcccaggcattgttcttgaataccttagaaagtttcattagctcatgtctctcctctttgtaccaccttccaacatttccctactgccttggacattaaagtccaaatccagtctgttcatcatgatctgtggagcctttgataatcgcagcctccagcttctccttcacacctgtctcctgtctcctgctttttctttttgtgcactgcccaagaaccttttcatctactaatctttgagtttgccgtcctctcttcctaaatcactcccctccctccactgttccacgtgggacgttccttccagagaggcctcccttaagcccaccttccatacctcctctggttatcctcagtcatgaggccctgcttcctcccgcacactgagcacaggcagtacctgctttactcatgtacttgtttattatctgtgtcacccagtgggacatagtagactccatcagggctgggaaggaatctgccttcgtcaccattttgacatcattatcaagtgcgcaattaggctcacagttgagctcaacataggatctgtggaaggaaagaaggacagaaggaaggaagggggaagggaagaagggaggaagggagggaaggaaggagggaataatttccaggaagcctcattggatttctttcccccttatttctgaaagctcacctctttacagctggcaaggccagcagaactgaacaatagagccggattaagcaagcattcaggtgcccacttaattcaatcggcgaatttgcatttctcaggctctgtgccatgagagcctgccgcctcaagggaccacctgccttctaccagaaggactttgctccttggagaatttccctctggcaatggtccaggtcaaacgaggtaccatacaaatgtggcttgtcaccattttccagtttaactttctcaagccttggctgcctcgatttcattccagactacagtagcagctgaaaaggtagctaccattgcagtcgaagacactggcagatgggactggcttgttggcagagatggcagagatggcagagatatgaactatctctgaaagggcattctgcatgccacagttaagtgctctgttgaaggacggctctggaagggagcatccgcgaaatgaataagaaggtggttattagtgaggtctccctgaaaggagcatagctggatgcaatccttggaggccctgtctagggcctgtctggggctccagctttcatagggccggccatcccctttgctctgggtgagatctgtctttgcttctggtgattctgatattcactatcgagaacgattgctttaaaacacatcagatcaaagttttctaaaatcagagtaaaagctaaaacctttgcaaggtcctgcatgacttgagtccctgttcctcccttgacatcaaaatggctgttgtctgctctcgctctctctctttctctctctctgcttcagctgtcctgacctccttgacctttcttaaaaactttatgaaaactccacgtttgggcttccctccacctgagatgctcttctcggctcctgtgagggctacccctttaccctttatagtgtctgcccggacatctcctcactagagaccttccctgaccactgccacatggaatagtactaatacttcatgctcatcctctgcctgccctgggtttttaatttgtgcgtgtgggtggggtggggggcgggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattastgaggactttgtggttcgaatggaatgagtgtgctgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcacaggggatgggaggggggctccggaagatccctaacccattgtggacacaccatttatgttagtggaatctggtaagagtgattgaggagagagcattgggtgaatgaccctgtaatccttataaaaatagtagcaacggtaactaatgatgtttatgaactgcctaagaatgccatgactgtgtcaagcacttcccataactagctcatgtaaagcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttgtcttacgcacaggcgtaagatatgcatctatcttggtgtgcacctgagaagtagttatgtctaagtttccgacttgacttggtagagtcatttgatcagtaaagcgcagagcagatgaactacctggaaagaaagtgccggaactccccacgtgtgacatctcacttcggggaaaggtgggccctgcgctgcgcttggcgaaggtaaatgcacctgggtatcctcttgacctggaatggtggaaaataaagaaaacttcagcatgtagcaagtagttgtgagtacgattaatgctgtttagagttgccagttctcttacgcactcagcgaaggccgtgtggcttcgcattaatcaccaccaagccaacatgagcttccagcaaaagagcccagtgattgggaacaaattcaaaacagctttatttcattgacagacaggacctttttgttaaactgtggtttaaagacctttacatctctgtcttgttcacacgttactgtagtcatttacgtaaacttaggaactaagaaccgacttatttatcacaacctattggcaggaaaagggtcacataaaaaagaatctttattggtaggtttttttttttttttaaagctaataaacagtgctagtggaaagtatgctgttatcaaccattattgaagtaagtgggtttctggactgaaaaaaaataaagaaaacatctaaatgtcagtgtgcaaatagaaagtagcagtcaattaaatgaggcagtgtgtggtcaccatagatggccaatgtctgtgttattagggaaagaagagaagccgggaaggaggaggaggtttctggggttaacctgtgttttgctaactggtgttagttagtctcagataagagctctatgtaaaccaactttggcccaaattgactcattgaaaaacaccttgtttcaaattttttccccctctatgaccaaaaagttacccaaacctttgtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagctatttccctaataccaaggcaatgcaggtcagctgcagtgcctaatgtttataaaacttgtaaatgttgaaacccacacttggtctgagagaacatcatgctccagtttgttcttaggaatgtgtttctgatgtgtgtgtgtgtgtgtgtgtgtgtgtgtgtgtgtgtgtgttttccagaaaccaactgggaagggccctaagctgagattactgttgagaagtaaattgtgcttttaaagtgtcctccagcaaaatggtctcctggctgtctttggaaatgacgtatcagtccagatgccctttttcttgatggattgctaggatttttactcaccaccgatggaaaattctcatagtctggaagggtggagcgtctgccttctatcatgattgtacacagatgagcaaagctccttggcaatgagtgaggcagacgggcagtcaggttcggactggtgcagcaggtaggctgctgctagggaggaaggaagaggcacagaagttcagggcgtgagagggtatgcgagagatgtcaacaatccaggagctggcttgcttcttcctttagtcagtggtgcaagcttcaagtggataattcaaatgaatcaatggaaaggcctcttttaacatttgatttgtttcttcaaagaacacagatgaagtttttctcatctctttagattagtgattctatattggtgagggagtggaagagaaatgtgggtgtgttgactatattctccacagaaactttttgaagtagcatcstcactcagcacagaacattttgacaatacacttccagggcaggtggtttcttactatgtccctccctacccccacatactttgggactcagaatgtagggagtgtactctcgagggatgcrgcccatacgtgaatgcatggaggcagcatataaggttgcaaagcactgaccttctctttttatgattcccatttattccatagactgtgaagtctgcctgtacatttccaggctagcagtttttaatcaaatgtatgatcactttcttctgatgaacacagttaaggggctttgttgttcaggtgagtctcacattgtactcctctcctaagagcatttattattacttgctacatacatttttgacaacctgacaatgacttttttgtcttaatttggagaaaacatactctgagcttttgaagttggtgtacttgttaaaggaagccagaaaagcttttcaaccatttgagagggtgtgaaatacagaaggggttgtgcgtttcttcccccctcatctcttagagccctgttacccaagagagttcaccaattacccaaaccaagtttcattttgttttctctctagtttgaaaactgtttttattgcttcaactctccttgtctaggagagctgtttcaggtttttagagtcctaagaaaggcttcactggctctctgccagcctcctgtcccattacacgctcaggcttgtagtcagttactctctgctggttttgctaaaccactcttgggtctttcttggcctcctgccccgcattccccttcacgttgtaaacgtagctttttaagttggtcccttgattgcttcaagtaattgatctgttggcctaaaaatgagtggctctgattcagaggtaggagttaaaccagattctgcctagggacaagtgtgttgggagctctgcttctctggagacaatggtcagcagtgttgcaaccaactccatgtctggtgcaccagatggtctcattgggtggtagggtggccaaaccttgtgtgagctggctcacttgttcattcattcattcgtttactcgttcttttttgtattagcttaaaaatgcttatacgccggccatggtggctcatgcctgtaatcctagcactttggaaggcagaggcgggaggattgcttgagtctaggagtttgagaccagcttggccaaaacagtgagactccatctctacaaaaaaagaaaaataaattagttaggcatggtagagtgtgcctgtagtcctagctactcaggaagctgagatgggaggattgcttgagcctagggggttgaggctgcagtgagctatgatcataccactgcaatctagcctgagtaacagaatgagactgtccccccaaccccccaaaaacagaaaacagtattcctatcatatgcattctcaactctgcagaggtcctgggtcacatttcctgcaaagttgcactgcctcccataggcatgagacctccacatggacagaatttcatgagtgttcaccttggtgttgctactttgcaacatagacttgaagattcagagaggagatgtggtaagagtttatttctggacagagaaaagctacaccattcatctagatctcattaatctgtattcattttgacatgcttttctgcagttgacgtttttatttattaagcgctttacaagatattcagtatcattatcgaagctataattattaatgatcaaagttagcagtacttgttttagctgtcatcttcatcatcaccatcaccatcaccatcgtcatcatcagggccacaacagcctcttcttttctcttaaatcttccagcaattcttcaactttgcctgtatatttatcatacaacataatcctagtatttagtaaatgcttrgtctttgatttcttattttcaaatgcatgtctttagaaccagaatgtgtgtagctgttttctggcctgaatttgggctgagatgatgagaagtttagttgccactttcagctwagtggaagtgttttccccatttggactccgggtcattgacaaacgtcatcactgtttttagttgaaatgtgcttccatgtggctgttcatcagcacacccatatctagacgtgtgctagcctcagtgagagttgcagaatctgtgtattcatttcctttatctagaaatcctcattatggtacataaaagagctttctatcgcttttttacattatagtagttattcgttattattattattattattattattattattattattattatttctgagacaccgttttactctctctttgcccaggctggagtgaaatggcacgatcgcagctcactgcgacctccacctcttgggttcaagtggttcttctgcctcagcttcctgagtagctgggattacaggtgcacgccgccatgcccggctactttttgtatttttagtggagacagggtttcaccatgttggccaggctggtctcaaactcctgacctcaggtgatccacccaactcggcctcccaaagtgctggggtttcaagcatgagccaccgcgcctggctttgttattatagagttatatggatttatcattttaggtggagatttgagtttatgtctcctacagacagccgtagactttgtttcattttaagatcagtgttgcagacgctgctgagtgtctccaaatgtctgttctccctttattacctactaataaaatacctaattttcaacagcctgggaagagactatatttccctgcttgcctttgcagctagagtgatcctttgatgaagttctagtaaatgggacgttagcagaactgtcgtatctcagggcttccgtagggtttataactgatccactgagagataagttgagagcttgagagtcaacctttagaaaagttcgtaactatttgtcaaaattaagcttatgtctgttccaggtagtaattttaaaatgggcttatattttgtatgtcctttttaatttcctttttctagcaattctcaatgtttttttaaaatctcttctggaggagggtacccttcacaaagttatttgccaaaggtctgagaaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagtycgagcaggcaactccgaccccaagttggagctgtgtgttgaagatagaagagcaaatatgtrgaaggaacctggatttctatttttttwaaaaatataataaatcatccagccccaaatgtcaggaacctgggtttctaatgatggttggctgtcacccccatttcccacactttaaatgagagaagtaaacatctgacttcctaaaaccaccgttctcactcaaagccgaatctcatcctgactgaaatgtcactagtccttttttttttttttttttttttttttttttttggtcatattttctccatttggagaggctggctgacccatcaatgggcagtgtgggggaatggagagacctgggattttggggacaacagtgaccatgaggggatctctacactcctacttggaaatggagtagcattctacacttaagtatctccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcagtgaccccaaagaccccagagaaactcagtatgaaaaatcactatggaagtgcaatagttattactttgtttggaattcactacaacactgtttctcaaaatataattcctgagtcacttggaagattacaaccaactgaattagaatctctggaaggcatcctaagagtctgcatttgtatgaagcttcccaggtggttctgctcagccctaagtttgaaaactactggcagaatagtagcagagttacttattctacattcgttttttaacccattgtaaaaatcatacatgtatgttcaagacaccggcagatcacaggaagggaaaaaaaatcacttatgcttccaccaccttaacctagaaacctttaggacttttcagtacttcctttctgtctttttcccctatacctaagtttttatttacaatatagttgtagccatatgattgttgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaaccattttcttgaaaatgtttcttagaaatttgttacttagaagatttgagccaatgatacattgccgagatttgtaagagtaagaccagcctacgctgagtattattttctcaaaggaatattatgaggcacatcccatcttcatatcagggaacaaactgtcacattttagtgaaatctgtgggttatgtgtgaccacacacagtgtcgtgtttgctccctttacagaaatctaagtaaaagaatcactttttcctagtatctggatgacttgatttcttactatcttgggccttcttggaaaccctgaaatgtagccttttcatcttaattcacaaagtgttcattctcacccttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtatgaaatgactgtttttatagggaaaaacagtagccgatcatcaattccctaaggttccacgtaataatttgtccaggtctcatagcaaaaaggtggccggatgaggatttgaacccactgctctccaacccctaagcccgtgctttgtagaattaatcggagctctaaagtacttgaccctgggcctgacaccaatcaggagcttaaaacccattagtttcttttttgttttatttttgcccactattaaaatgtgccaaagtaataagatcaaacagggcccctgcgttttgacaaacatccgaattctgaatttcagcgtggaacagggcatggaaagcaaacacaatggggaaaattgccgtggccggtcccgacaatgtgtggattaaaaaaccacacgcatgcacagagacctgatgtgaatggtatttctgagtggaagctaagtaggagctgaaaatggccttttaaaatacagaacataaggatgcaattcacagagatggtctaaactgtaaacatgcagctgtggggtttgtgaggctcattgcttacataccgacagcatacaaattgtcaagtacttaaagttccattgttgctgaaagggcctccacccaatgtccttaaatggtcccccytttttttttttttttcaaaccacaggatttacatctctcgtagcatctaatgaaataccagcaagaattgtgtgttggtgtaagaaataataatctttccaaatccttttgttttgttatcatttgctaatagagatctttgaaagaaaattcaaagattgaagtttgtattctcctaaactcctgcaaagaagtcctgtgcaaggatcgttcactagtgttctgcatcgttcttcttactcaactctcccgagaggcattgtggacgcctgtggggttggtttttggcacccatccctgaccccttcttctccaggaaactctgttcctacctgctcctcttgtggctaccttgggaggtgccatttttatcaaggttagtgtgtggttaagcaccttgccacaagctcaggggaaaaaaaggtcccctccccagattttttttagaactggaagtttccatttcctggcactgctgaaagctctaggacataaaacttgggagccgatggccttcaggctgcccataatgtgaagagaggtcatttcagacattcagataaagtctgtggctccagtatttttctaggtcttgctccctccctgaccttttcacagtttggtgacacaactcttccttgaattccataggttgacaaattcccctgagtttgggttagggttttgttacttgcaaggcaggcatcacagggctgctcctggccatgcatagctttggaatcacttctctgattctcatggctcgggaaggagaaagtgtcctgtgtgtggagatggcagggtggctggagttgagaggagagtcccttgaatgccacgcaacatttctctctgtaggtgtcctctgcacactgtccaaactccatttttaaccttgactgcatagtaccatgtacattcattaagcatccctcgccataggagaatctgagttcctgggagcatttaacacagttcctggccttgagtaaaaacttcataagcacttgttgaattgaactgaatttgttgtctgtgtttaaaggacttgatggataaagggagatttaacagtttatagccagattggactcaaccatgatgatttctggtccatcttttagaatggcttcacttctcttggcctttatttctccaagtggtgataatgagacctatccctaacggttaaagtgacatggtccatttaaagtgcttaaaccaattgccaggcacataataggtgctcaataaatacttcctttatttccctgttaggcctctcccaaccagagatcaaagatgattggccctgaagttatttttccccccaaatttgatagaaatcagtagagatgctaaaatataatacatttgacctgcattgatcaaggtaggctaactgctataacaactttacaattagtgccttaacataatataaaatgacttcttgttcatgtaacatccaaggtagctgtacctagttgcaatgctctcttccaagtagatatttagggacacgggctccttctatcttctgtcaccaccacctttatttttagcatccgcggtcttagcaacagtagaaggaaagaatggagataagacagtgggtatttaatcaccttagcccataagtgactcacgtcacttctgactaccatatccaatttttgcctctctttttttcttgggttccccccgacaaaaaaaaatatgacagaagtatcacccatccagccagccagccatcaatccggtatccattcatccatccatccatctaggcatcccaggtgactcattcctgtgaccttgggagacagtctttcttcctagaggttgtttgccccaaccccctgttacattcttgaaccatatgtttcccattgtttgcacttcccctagtcacctggtgctttaatttttgcctgtaaccttctgaaactttccttaaatgttcggctttgacctgtcattcactaagtctttcaccatccttcactcatcttacctccttcttctgtggcatttcataaatttaatgattgtaattgtgattacaacataattgtttgtgtctaccccaggctttgcaacagggaactatatcattattttgcagacacaacaaattctgcaagcatgtatctttggaataaaggagagagggttggacacaaatgtgattacaacatatgcttctctgggcatagctttgccccattgcacgaatatagaaaatttggcaggctgaaaataagcggaaagatcctcaagctgttccttccaccccctgggatgctgattaagttaagatttcagattttatttattctacgggtatttgttgaatatttatttcttamgatrccacgcactgctttaggcactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatagaattcaattcttctcttgccacamatcagctgtttatactcctctttgcacgttgcagaagatcaggaatttgcacattatagccacaaccatacccagaaccagattgtctaacactgaatctcgaatccamattcctggatttggatggactcaatctggacccagtatctacatttggtccagtcatctgtatccggcatcggggtcttgttgaaaaaccatggcttagccgggtacagtggctcatacctgtaatcccagccacttgggaggctgaagtgggaggatcgcttgaagccaggagtttgagaccagcccgggcaacacagggaggcaacatctctaaaagaattttttaaggaataaaaaggaaaagcatggcttttattctaagagcaaaggcattttgtatatttggcaggtatcccaacagatgcatcacccagtctcttaaattaagataataatttatttggcaagtgaattcttctagtgtagttagatagtgatgaaaagatttttatacctccaaacacacacacgcacatgcacacccaccaggctcttctttacttctcactcatagatttgaaaacaactattatattatagaagttttttggtatagctgccaggggtcattgtttccatcccctgtgtggagataagaaaatcgagatccagtggagtgtggggtgctgagagaacaagtctatgttttcttgagacaaagtcttgatctgttgcccaggctcgagtgcagtggcagcatcttgrctcactgcaacttctgcctcccrtgttcaagtgattctcctgtctcagcctcctagggagctgggattacaggtgtgcaccactatgcccagctaatttttatattttcagtagagatggggttttgccgtgttggccaggctggtcttgaattcttgacctcaggtgatccatccactttggcctcccaaagcgctgggattacaggcatgagcctaactatcctcattaagccatctgctttctgcagtcattttcatggcgatgtgttataacaggacagaccttgtactttggaatcaaacattctcaactctgctatctgctctttgtggggccctgaacaaaaatmtttactctctttgagccttcgcttcctcattggtcaagacttttctcactgcattatatttgagtgagacccgtatcaatggattgaaattctcagaaacccaagaccaggaatagcccagtgacaggaatttagaccatgccaagtgtgaaccatggcttgcgggggctcctgtctcacgctggatgctcctgcctggctgcctctggtctccagcagaagacctgtcgtgcttgagtgacaaagcagattgcttcctcccacctctgtgggttaggacccctttttctatcctagtttcactctgatgggcgagttcactcacagtgaaaccgtagcaaaacctcaaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcccgagtgttttgatttcatcctatacctatagttacaggccatttaagatccacagtctgctcttttagcttctgccagcacatttggacatctgtgcagttcccagggcaggtgaagagttgttcatgtgatgcaaacttttgagaagggacgtgtagggaagatgggagggaggtgatatttattgagtattttctttttgctttcagctttataccttgtgtgtgcttacagaggtcatgaattgtccgctgttgtatgtgtaatccgtggcagatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttcagccattttcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgacacttccagatggaaatattaagagccagtgtgtggttcaccctgaccccttcctatgccccagcaattaaggaagcaatgttcagatgaaacccatgtcttcctcctgggtccctgagtgaccacagtcaacagagcttccctgttggccattactaatgtcaagaacaaagctgtgtaaagtcactaagattttggaggtatcggctgttgcagtagaacctagcctatctcacctgacacaaacgttttctttctcacaaaacctcacaccagtgttgttttattcatctgcttatgcacgcgtatggctgcaacatccttccaaaatgcattacaggctctaatgcacgataagacagttaggttcgaaggaaaacaaagacaattgcacggcacagagggaatatactgctacggtaaaccgatcactaacayccggccctgaatttgcttcaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggttaaccactcgcatcagttttaagtctccacaggcagaaccagaccatcgtgaacttcttgatttacatggtggtggagagtggctgagaaaccagggagaaacaggaaggagctgattgaggagaccaaaggagggtggggccgcagctctcaggcactcttggtgttcagaaggccagcttgaagaaagatgtgcatatttgcaaatgcatttcttgttcctagtgaagaggtgaggaaggacactgactgtgctagagctgtacaaagagaagtagaactctaaatagagaaaatatgtaaagatcaataaatcacaccaaaaataagtcataagaacaacaaataataccaggaataaataatgtaaaatataaataattcctaaaatggtgataacagcttatgacaagtaatttcttttttttgagatggagtctcgctctgttgcccagggtagagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcrcagtgactccttgttagggwttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctcccaaagtgctgggattacaggcatgagtcgccacactcaattatacacttaaatatacatatatatatacaatatacatatgtaaatatatctgcatatacatgtttagggacaaaaacacgggagtaccatttctgtctttgtctctctctctctttctctcacttgactctgttgggagctatattagttgttttctctttccaaaccaccttctggaggtctcttagattttcccaatgatgaaggagctactgtctaggttattacagtagtaatagtggccaagaaaatgatatgaggttgaagtggacagatgatgcttttcactcttctgggaggttcccactgggtggtctgctttgctgagctttgaaaaagagcttttcttcttcccagttcactgggccgatgtgggcacagcctcaggttttggtttttttctcctttgctccttcaccacctagaaaactaatttcctataaagaaaatttctctggaaatgcaactttctcaataggttgagtctactcaaagactgacaggtaaaagtggtccacatagaaaaacctgtttctctattttgttttcaaaattatatcatctttataataactgttagtacctagaaaaatgcatacattttattccttaccaaaaccagttaccctatagtcaaaaggcattcagaagtattagcagaaatgtagtcagtagccaggcatagtggctcacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgagaaagcgtgtcttctggtatgtttcttgatacattttgagggtattgagctctaatttacttaagatgaccttttgaaaatagattaacttatcaaaacttgtggtggaagcaagactttgtcagtacagtactatccaaattctaaagtaatgaatgcttctctccctctggagttagagacctgactctggggtgtggataaagaatttgtgtcctggccaggtgcagtggctcatgcctgtaattccaacactttgggaggccaaggtgggaaaatcactagagtccaggagtttgagacctgcttgggcaacatagggagactctgtctctacaaaaaataaaaagaaattagccaggcatggtgctgcatgcctgtagtcctagctatgtaggaggctaaggcaggaggactgcttcacgctgggaggtgaaggatgcagtgaactgtgattgtgccactgcgctccagcctgggtgacagagtgagaccctgtcccaaaacaaaataaaacaaagagtttatgtgttcagtaagagctgcagtcacatctctagtacagactctgcagagcactaggaagccccgtgtctgaatgggatatggtgagagaggcagcctagggaatggagatacctgggggtccccatctgctcctgatggacagctcagatgaccccaagaccctctaccaggcactgatggagtaaggatggagatgggaattgcattttagaggtaagaagccaagtggcatgatgaggagagtattcatgaaatttatggaacagtctgggggaaatgccatgatttcaagcccttcacctaaatcttcaaaagtggcatggatcagtgcctctcttccccagccaggagcgtgtgaagcatggggacctccggaatgttctcagaaaatgcttggttcttcctgtgttgagcagggaagaagctgaagctagcatgggcaggggagaagaaagccagttacatatcaaagaatgcttatctccgtagacaccactgtgtttgagagtcacattgggtggtttgtaggcagcttttcattttcacagccagtcaggcaaggcttggaataacttgtctaagaatcctcatcttaaccctgtgctagaacaacaagcttggaaggagccagccaacaggagaaagccagagcaagactctgtgctggacaagaagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagtttagtacgttctcttggttgcgaggaaatcactgaagccacctcacgtaatgtgagcatgtatgctcaaggggaccaggaaatgctgaaagttcaggcctcggaaaggacaggatgtggaaggatgttctggactcaaggaggcctagggacccttggcaggaggcattcatgggtctgtagtccaaggctccactaccatctccttggcttctctcttccattctagcttcttctgcttattcatcacttttgcttcctatgaaattggtgcatcctggtcttggcctctttgagccctctgtatagtgtgagctcatctggtactcttgactctctcaggctcctgaaggagaaccatcagatagaagcatctcatctccccaggccatgccactgggcctcagccaggcttgaactagctaggctcagtccacggggtggccttcaagcagcctagacttggatccctaagcacagcctgtggatgggacgttttaaggtaaagggaggacgcagagcattgcagcccgttggttgttttctccagcacagccatgcaaaatccatgtagcggcaggaattttgcagctggagttgctcccctgagactctgatcagataaagacagggtttgctgaacaccgtaggtctggccctgagccgtgggcagcctgatgagcacaggtgaatggtgcaagggataacctcacagtcatcagcaagtcttatctgggccgctgcaaatatgacggagtcagaaaaatgacaacataaagaaatgcgatgttttctatgggggtttctttttgaaactaaaagaggttttctagactcactccatggagaccactttactttccatttttctcagatgataacatctgcaggggggctccttctgtgggtacatcatttgtcaaatatgtggtccatattgagaaccgcataatacttattaattaccacagttgctacttaccgtgggctgctaagactgctttagatatactgcagatattcaaagagaattcatcgtccacccaacggcaaagtccatagaagcccaggatgcattctgaccctcatcctttaaagcttactgaacatattgatcacctcttttccaaaggatacttcctattggagtgtacttttaaaatctattttttttgtcttaatgtttagtgtaatgagggagtataggatgaactcaatgtaccttgaacatagctgttgtcaggaatgaagccaatttcattttgcctgaattagggccctttggtgtcttttctgtatgcagttaatacagttcgtgtgctgtaccaagggtgcgaatgtgacttttcatcaggaaggccgcatatggtgggcacagggcctagctctgccgttttatagctgcataactggtttcttgaccttttatgagtctctactcatgttttatatggagacattagtcatctcacaagatttttgtaatgattagaatatttgtaaagttcctggcaaaggtttgattataaattagcgtcatcatgaacgttcaaggtggggaccttttttttttttttttgaggcagagtctagctctgtcgcccaggctggaatgcagtggcatgatctcggctcactgcaacctcctcctcctgggttcaagcgattcttctgcctcagcctcccgagtagctgggactacaggcacacgccaccacgcctggctaatttttgtatttttaatacagacagggtttctccatattggtcagggtggtctcgaactcctgacctcatgatctgcccgcctcaaagtcccaacgtgctgggattacaggcatgagccaccacgccctgctaaggtggcaatctttatacataaaaaacaggaatgacttcttcgaattggtgcactagagaaatgttttccagtcgcctaagcgtttaagcatggtaaacagattaccatattagttgcccagaccttgcaaaacttcatagtgtttgtttgtttcccttgggaggctgttctgagaaggaaccttttcattcctcggagttctgatgtgttcattggcccctgttgtcatgctggatatgggggcggttcaaggggggcttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtggatataatgtgttgcattggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcatkctacttggggaaagagacgtgaaagaaatcaagacatgcaagcaaggataagtgctgtaaagataattcattcctgtttagagggctgaggacaggaagacgatgctgtatggctctagacagggttctgtgatgagtggcctgtggacagattcctgtccgaagaggtgcagggtgcaagggaggaggggacggcaagtatcaaggtcccgagtgaggcacatgctcggcggggcccaggcatgccaccaaggccaggaggagagactgaggaggcttggccatgccctgccttgttggtttttagaaagactctgttttggttattttgtttttctttttttgagacatctggagtgcagcggcatgatctcagctcactgcaacctttgcctcctgggttcaaacaattgtcctgcctcagcctcccaagaagttgggactacaggcattcatgccaccgcacccagctcaaatttttgtattttttgtagataccatgttggccagcctggtctcaacctcctgacctcaggtgatccacccacatcggcctcccaaagtactgggattataggcacaagccaccgctccaggcctagaaagactggattttaccctgattgagcgagggaggctctcgaggttttatttggttctgcccagtgaccagccaccataaccacatccttcccccagactttttcctcttcctataaaacaaaacaaacaatgtgaacaacaaaagcaaaaacaaaaaactaagtagtagttggggcatttttattttaatgctgcttttttttttctcaccttttgctatatgctgatcccagtgcatgaaatttttttgtaatctcattcctgtgttgaagctctttcactgctttcgtgagcacagatgaatttgaaggctgccaggcagtagcaacatataccagcttccccactgggtgttcattctacccaatttttgttcatgtggacttcaggaatctgggatttatgatcttcggatttggctcttggcttgaggcttagcctgtgcagtcatcttggagagagggtttactaagcaaagaacaccccagaacaatctgggggaactgtgccctttgcaagagagcagttttaaagtaccctcgggcaatttagaagctcctactgactcaaggatattcttacctcttcgttaaagcagctcgcctaaggactttgctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaacccctttttccagtaaaagtcgttggcgaggagtgaattgtgatggaaacagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccataggagtggagtttggatttcaactagataaggcccattttcatggatggacatgtgagttttcatctataatatagaatgctattttctagttaggttggagcaaaagtaatcgcggttttcaccattatattcaatagcaaaaaccgcaattacttttgcaccactactttttacctagcagttcaacagctgtaaagaaagatgctgagctgttggttacgtaactgtggtacagccatttcatagacaagtctacatcaatgaaaagaatgacacttctaaaggaaaaaaaatgggcaaaaattatgtgtttacatctatcagaaaaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaatgttcagtggcttattgtgacccaacatttttctgtttgatttagatagagcttttatttgcctaaaaattgtgcttgcaatatatatgatgatttttttttcttttattaaatgaaaaagagtcatttaacagtcacagtggctcagccaccacccgcagcaggcagtgggcccacttcaccttcccagcaggcctccagtgcccggtgcagggtggcccattggcacccacaacaaacatcacgacattacttttaccgcacacttcctgtcgaggcacaggcagtgcttcagcctttttggtaacttgaatgaacatcaaaaggataatcagatattagttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttttttttttttttctttttttctttgatacggggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttcaccatgttggccaaactggtccagaactcctgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtataaaatatgtacaaggatacatatataaacttagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtgtcatcagcccaaaccagatcagcgtcgtgggcgatttttttcactttactgctgaggggatttgccaatcgcctggtcagcttctgaattcttcgggcacacaggaggggcgacatggttctggcttatttctaagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctaccccaacagggctttctccctctggctgttttatttagcgggagaagacagaagagatggaaaaatggaccctgcatttatagctgttccttcaaggagctcaaactgctttcaggcatttccttattacctcattaatcctcataatggtcccttggcagaattattcttattttcagaatggagaaattgaggcacggacaaaataaatggcaggtggaaggtcagagagccaggcagcagaagaggtgggggcagcaggatggcttctggtttctgccctggtccatcagtcagaatgtcctcttcagatgaggagatgcagggtgaggcgcgggggagctgacattgcataaataataaaacaaatggagccacatttagttatcactcatctagcggaagtcgatcttcttgggacatgagtaggctctaacctggcaggtttttcaacatggaaccattatttgtcacatgtgttctgtgtgccagggactgagttcttctcaacggagtttacatgtgagaggagcaagggacaaacctcacaaataggaatacagacctcagaaagccgacttcacccttgcatactcctccaggttgccctcgcctcccgcctggatcactgctcaattctctctctctcttttttttttttttttttttttaagacagagtcttgctctgttgtttaggcatgatctagctcactgcaacctctgcctcccaggttcaagtgatgtttcccacctcagcctccctagtagctgggactacaggcatgcgctgccacacccggataatttttttttttttttttttattggtatttttggtaaagatggggtttcaccatgttgtcaaggctggtctaaaactcctgacctcaactgatccgcctgcctcggtctcccaaagtgctgggattacaggcatgagccacagagcctgaccacagtcctttcttttaagggcctcctggcacccagccatgttgggaccctttcagttctttctccacggagaaccagaatctcctttgaaaatatgttagatcacctctttctcctgctccgaactttctgaaggcgtcccctgttactcggagtgcaagccatgctctcgagctggccatggcatcctgcgtcctctcccttcccccattggctctgttcttcctgccagtgctcttccccctgctcactgggttccagctgtgcgggcctccctgctgttcaatggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctsctttatttttctccatattatcattgccatcaatccaagcacaatttccagttacttacccattttgctttctccccgctctttgagaatgctggctccaacagggcaggtatttcacctgttttgtttatgcctgcatccccatcactaggaacctcataggtgcttagcaaatttttgatcttaatacagaaattgactctcacagaataagaagaaggagcttgaagccgaggtttgtgcccagaagatctcactagattctttatactctggggagaagaaaggatcagggtcgggtggggacatctgtgggcatattggggagggggccaggaagaagccaggaagggggcatgctgtcattcgtgggttttgcaactttctgtggcatagaaggcatagaaggatctcttcatttaaaaggtcaggttggattttttttttttaacttcaacaccagttaacttacttgcttccatcataccctgtaggtactcgttatggacaggaatacatgtagggtgaaggctgctctgggtcagtggattcacagagaagtcagaattctcttttataaagagcctgcttttctcaataattgcataatgacgtctttgattcccaggccctcatgcctagctgtttccttaggcatttattcaagatccgagatgccattcgcaatccagcaggatgcatatttgtatctggctccaaaactttttttttttttttttggcccacatcactgcagcccatggcagaagagtctagcaattagcaggaactgaaagtgataatttattgcaaccaacgctgtgatctaatagtcacacattacaaaagcaaaatccatattttgttcgcagtggcaccgcagcgctatcatatgctccacatgctttctaatgtcttttgtttgtattaggaaaaaacataaccctctcctactgagaaccagagagagcccctcaggttctgagaatgacgacattcaacatcgtactccaaagggggttaggtttgtgtgctaggggtgaacgctgtgcaatttaattctgtttccaaaagatctttggaggataaaggatactttctgtcttttatttagggaaggcgatcatgttggcacagggcataagagagtagcggggctgagagtgggaactgaggagattcaagccttttgcccgtcgatcgcagttcagatctgttgattttgaccattgcatcttgcctcacatctgaacttcaggtgaagtttcaaaccaccaggcaacatgcattacaggcaaaatgataagtcaggtcctgccgggtgactaaggcagtgtggcaatgcttcaagcctttaaaaccatatcccagtggccccaaagcattaatatgtctggaacattgcctgtccaatatctagagaggcgcctgcagaatttgattcctaggtacatcaagtttttgagctggaagaaacttgagacgctctttagtccagcaaatttcaaacctgtctgctcatcagaatcacctgggagcttgaaaacacacagatgcctgggcctcaccatccagagagacattcatttgattgcagattgaatccagaagctctaagcagaggcacagtcacatttggggactccttttatttagtagaggaggaaactgagtctcagtgtctgagacagacagtggggattgaacacagacacctgactcccagtgggtggtattttctcctagagtgcatttctgcttcttaaccagcagaagaaagcccattaactaacccctcaggggtcaccatgggcaaaggagtgcatattaagaactgtctggaaagaaaagaaggtcattggaatcttcttcaccccttccctggtactgatggttgcatttcaatggatttctccaaaagcaattatcacagtgttcctgtgtgttgagcaaacttcccttgtaatcaccttagcgttttcttttgttaaagagtaagaagaatggtttcatagtgaatttttcctaaaatgtgcagggtgtagaagaaggaattgcacacaatacatgtctactaggcaggtcaacataaatgagtagaggcaggtaataacccagatacactttgttggaaagtggaatgcatagaaatggtcttcatttctgcaaagaaaaatgtacattctcctttttttccttgcaatatgttgccttctctgtatatcttttaaaatttctacttctgatagagtaaagggtatagttttgtccgttttgtgttgctataacaaaatacctgagactgggtaattcataaagaaaagaagtttgtttgattcacagttctcatgcctggaaagttcaagattaagcatctggggagggcctcaggctgctttcactcctggcagaaggcaaagagaagccagtgtgtgcagagatcacatgggcagagaggaagcaagagagaagggaagtgccaggctcttttaaacaaccagctcccgtgggaaatcacagagggagaactcactcactaccatgaggatggcatgaagcccttcatgagggatccgtccccatgacccagacacctcccggtaggctccatctcctgacatcttcacacaagagatcaaatgtcaacatgagatttggtggggacaggcaaaccagatccaaaccatagtgactatgatatatctttcacatttctctttacaaaaagaaaaacaatgtaaggtcccgtgacaattagccttactgccggggagaccataaggagtggtggagactgtggtaaactgcagcgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtctgaaatccatacagtgggcagtcgagagaggcagacaggaactcttggcatatgctaaagctgctatccacaggcagaatttcttcttctccaggaaaagaaacagttcttctcttaaaatcttccaaatgattgactccgtcacactcagaccatctaagattatctcccttcctaaaaggcagctgaataagggcttcaatcacatctacaaaatactgtcccagcaacaccttgattcatgtttgactggataactggaaactatagcctagccagggtggcaaacaaaatggaccatcccagggtagatgttaaaaaaaagatacccaccaaagataaataagatcaagattagaatgtcttcttttgataggatgtctgatttttctgaatttttgttcctaaaacataagattatttttaaaagcctgagaaacgagacattagtgatccgattcagaaaagaagccctgggtttaagccaatacgagatgggtttgtatctttaagtggcctttattaccacagtaataaacagcaaacgggcccaaatcttacaggcttgtgttggctttgaccaatgaagtagaacaagacctctgaataccccgttagttccaggctgtgctttgatggctctgcacagacagctcttttcctatacaagtcaccagcctcacccgtgtctcttaacaaatgttgttgacaggccgcgttgcaatttttctgcatgttctgacagtttaattcagtacctcctagctaagcactcagcctaagggggtgcttcagcaccttggcgtcaccaggctgcaattaaaataattcagggactggggctgggcttgcagaaataggccttcttccctttggaacatacaatgcattttccagtctccccgtggagcacacgagatccttttagagcagagggcagtggaatgtattaacaagatgtccactggcaagaactagctccatttgtatgttgcacccaacggggttttctccataggggttaggcgtaacgtctttggtaaacttggcacctgtagaaaggtcttgtggtgggcaggggggtgtgaatgggggaatgagaactagggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcaggtaaggtggaatttggtaaattccccaaatttacaaatagatgaaagttgggtaaattccccaaaattacttgatgacaaagatcatttgggagagattctttcaaaaatgcctactccctattcccatatcccagcctaagggaatgagtttaagtgggtctacagtgggtcctgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagaggtaggaggtacataagagaaacgtgttttatggctgtggttttcaagaagtacagcgttttggagagagtggaaggctttcatgcatgaaacactcagggaggtaggagatccatgagatccaagctaaacaattctggaagagttacctgaagttgacacttaattcaagctgcatcatcttcctcctcccagcagatgaagaccaaaggtggagggtggtgggggtggggggcagggagtaggggggagggggggagggggtgtggggagggtggggcgggggtgggcaggttcagggactgaggccggaagcaaaacaatgtactggagtgcttatagtttttgaggaatcagtgagaaatgtcatctgaatgtctcttctcaatctttctgaaagataacttgcctataaacataaaattaaaagcctgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgagctggtgtgtgctaatacactgctaggagccattggagatttgaaatgtgagagaatgcctgctgtctgtcgcatttaccaaacatcatgcttttcaagattgttaaaagttgctgaaacccttctttgaaggaaatcatactttgaagctcaatatatagcaaacgggtagaagagttgctaagagtttgaaaatgatctcattaaacaagaaacatatatacagtgcctacctaggaaagagccaggcatataatagccactgcataaagatgtcaagtcttttggacacaatcctaatatctcggaggttctgaagctaaagggtacatgtttaaattttatttgtttcattaaacacctaaagactctttctagctcactcctgccaaaggcagaacttgagagtggcattcttttctggtctttgaagacgacaggtgaagggcagaatgtcctgtgtacttgggcacgcacatgcaaccctggctggtggctcctcctctctgtcctcttcctccctctcttccttctcttccttttcttcctcatcctccttttcctcctcctcttctcctttctcctcatcctcttcttccctcttctttgtgtccttgtttccatttgcttcttgctttgggcaagttctcaccataaccctctggcaaaggcaaatattcacctaagtggttaagtctctgggcatatttgttgatctctgctgagtctctcagcccgttttcatccctcctctgcctctccctagccattagccaaggccttgacctattgactgcagtgttgccgaagcagctggactccgtgtttgaaaggttttctgaagaggcatctattaatttatgtatttaatttctgtatgaagtgactgttctcctcccagcacaggtattaaagtacctttaggggaatccagcagctgaaatcctcagtaaggaaaaatgcttagagtgtcacaaagcaaacgcattagtgggaaatgtttaggggctcaagcacaaccacaaggattcactccttccttggattttgtgcctcttcccctgttcctgaggcccccactgggaacccttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcatattagctattcataaagggttttaaacattattattaatcctagatatgttacttaaactattaagtccgttcaaggcattcagtttctgagtcctcaaggatggtaaggagagctgcaaatgggctcccttctcaagcaaaggcatcttatgccatcatgcacgtttctacacatctgcctgtagatacactctgtaggacaaaccaggtggctctgtccttcaggcaaagagctccttaattgaaaatgatgtgtgaaatttcaagagagaagtctaggaatggggagatttatgtactatagtcagtaaccaatcctgagcaaaggtaggcacagctatgtggtggtgcccttttttgggggggggggggcgggtggtgggggtacttactaaggaccttgcctaagataatcaacaatttttctttttcagccctgggaggctctaaagctggaatcaaaaagattcacaaccccacaaataggtgaactactctaaagcaatggttttcaaaccttgaaatatcctaacattgaaaaaaaatgtggtaacatagggttgcctgtgtcttattttggtctgtaaggacattaataatgttttggtaaaacctcagttatcatctgctattactgttatttcataagacacatcattttccttcaaaattacaatgaaaactcataagcatacatcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgygtacttgcaatccccacttgascaaagstgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagttyacaaaagtggaaaatgtgatatgacagactggawccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccatattcgtacccatgtacgtattcatacccatatctatacaccttcccttatccctgtccctgtctacacccacacccatacctaaaccaatatccacatttatatctatacctatacccatatcaatatctatatttaaatctgtgtatttagatatttctagaaatgcatatatagctatttttgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagcaatcctcccacctcatcctcccaaatacctgagactacaggcagtcaccaccacacccagctaaatttcttttgtgttgctatttttattagaaacggggtttcacctttttacacaagctggccttgaactcctggactcaagcgatctgcccttcttggcctcccgaagtgttggaattataggcatgagccactgcactgggccaggaatatctttctatgacagtaaatattattttacatcattttcagtgataccatagtatcccattatatgcttttcagtaataagttcgaagccaagttcctggatcagcagcatcagaatcacctgggaatttgttagaaatggaaattcttaggccactccccagacctactgcgtctgggggcagggcccagccgtctatatttcagcaagccttccaagagacttcagtgcctgctaaagtttgatgcctactgccttaaataaacttcttcatcccttgtcaaacttcctaggggagcacattttgaatttttgacctgagacctcaaaacttttacctgtgctcactcagttcaggtgaaagaatctttggcattcagaagcttgtgttcacactcacctacttctcatggcatgattcctcttacctctaaattctactgacttaatcaagattgagggattctgggatgaatctggggacactttttggtccctgaaataaaatacgcaaactttggagtatgagtgcgtatttggggaaagtatacctatcagattttcaagaacttcatgaccctaaaatgactctttcttaaaataatttttttttttttttttttttttttttttttttggagaacggtctggttctgtcacccaggttggaatgcagtgtcaggatcatagctccactgtgtgacctcaaactcttgggctcaagcaactctcctgcctcaagcaactctccagcctcagcctccgagtaactgagactacaggttgtgtgccaccatacccagataatttttttttaactttttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttggggtttcaccatggtggccaggctggtctcgatctcctgacctcaggtgatgcacccaccttggtctcccaaagtgctgggattacaggcatgggccaccgctcccagcctttaactttttgtagaggcagaatcttactatgttgcccaggttggtcttcaactcctgagctcaagtgatccgcccttctccgcctcccaaagtgctgggatgacaggcacgaatcaccgcgcccagcccaaaatgactttttatttgttatttttgatctcatccttgctgttctgttttgcccaggttggtcttcaactcctgagctcaagtgatccgcccttctcggcctcccaaagtgctgggatgacaggcacgagtcaccgcgcccagcccaaaatgactttttatttgttatttttgttctcatccttgctgttctgtttttcccagttatatcaataacaaagaaaagaaaagaaatctactcagggtctgttgggcatactgcccaagcacagtgtgaaatgactgccttttcactttttatcttttggatagcccaaagaccagcctgacttagcagcctgatttttctttgctggaggcagatcacactctgcagatctccactgaaaccccaccctcacccttcgtaataggcgacatgcacattttcatgtcacatttaaaaatgaaatttttcttgaaaatgttcacatccttcccccagaaattctagatttataaatttctcccaaggaaatcattaggtgctacctgaaagtttatgtatcaggtaatgatcacaaaattataatcacaaattaaaatagccataatgtctaataattcgacattagtgacagagatgatactacagttataggatgaagtgtcataactggggattttggaaaatgattagggacatggtgaagtcgtcatagaataaaattaagtgaaaagagtcaggttgagtgtagaatatatttattcctattcagcatatgtattacaaaatatctgggataaatgagaactgcatgctgacatttacattttctccttgattgtcttatctattatcaggattttctacaatgaacatttgttggtttataattggggggaaacctaaattcataaaataggcactctgttggtggcaaggaagcccactagtccactgtctaagtgttaaatggattttagcttcataattctggctttgactagaccctcttacaagcaagactatatcctctgcaaaagcatcagcggggtcctgcagtgccttcttgacacacacatcagtgtatacccagagctcttgtttctaaatagctgagctgcgtattaagtatggctaaccacacatccatgcatttttctggtgtctacctgaccacccctccaggggagagataaactcaaaggggagaaaaaggtatgggagcgaaagattgcaaggtgcaggtatgtttgcagatgaagggattgtccaggctgagctgtgcagtcctggatgaaccaccatctgggcacttcatatgccattcatacttaagggtgattggctattttcatcatcaagaaaaacattgctttaaaattttccatagttattcgggcatggtggctcaagcctgtaatcctagcactttgagaggctgaggcaggaggattgcttgagcccaggagtttgagaccagcccgggcaacacagtgagaccccacctctacaaaaaataaaaaattagttaggtgtagtggcgtgtgcctgtaatcctagctacttgggaggctgtggcctgaggactgcttgagtcctggaggtcgagactgcagtgagccatgatcatgccgctgcactccagcatacgtgacagagcaagaccttgtctcaaaaaatttaaaaaaaaaagttttttttttttaatcgccataatcttgtgtgaaatacttggtcatctgagcaacattatccttcttctccccatcagcctggcatgagcttggcagatgcaagctcagatcatcacctgtgtgagtgtgttgtctttgtgtccgtgagcatgtgtgtgtgccctgggttcctctcccaggtactccagagctcttgacaataaatgagaacaatatagaggcagggggcacttttcatctcaggccagttccaggactctgtgtaaactgtactaagccgaaacgtattcctttgtcccttttgccgctgtcctcctaatccacatctgggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaagagagagccgggcaggttggttttaaattcaaggatttatgttgttaatcctccgggctaattataatttatgggatcttggcaaattaatatgcagttgctattcaaaagtggagagcaatgtaaggcaggcataaacaagccttgttcatttttaatttatttccaccaatggagaatattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaaggcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatctgtcagaaaactttcactgattggcaaccaccaggcaggtaggtttgactcatgtgataattggttgcaccactagaaatgagaatgcccctcctacttccccgccacctcttctcctcttacctttttctccccgacatgcccctgccaacctccccccatcattccagctgggagaggccatcaaatgtagcttggagagctatagaaaccttgagctctgagcccaaggagcaagttggagtcctgcctccagctgtgtagctcagataacagctggagcagagaacatgctgttctctctgctagaatatctgacccaattctgactagtaaagagagttaatagtttgtacctcaagtcattcttgtccctgtgtgaaggaagagaagcagtcatttccctccacctccaacacacactccgtccccactctgtctctcttggctgtttttctcttcattgttgttaaactcacgttcatttctcttgtagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtmaagaaatggcagattttcccccttccattcccacccttgcacatagtaggttctcagcaagtatttgtagatgtaatcgaccagcagagatcatttgtacccttaacacccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcackcgagtatcctaattattttaaattcataatgaatagtcatcatggtttcactttttttatgtactcttttgaaagagtacgatgggggaataaaagccagaaagttaaaaaataaaaatagaaaagagctgcaattgtcaagagaccaaaaagtcttgtaaaaagggcagtaggtaattctggaggcaaatcagcatgggtaatgtctaggcaaacaggatagaaaaagatcaggaggtcacagtgacaaaagtatttaggctcatcatattagaatttcatccaaagaacaattgattatgatttatagaccacaccatcccatgagcccagatgtgtgtccactgggcctggcaggggacaaatttatgtaacagactccatcctgaattccagtcctcaagctttgagggtaataaactcaagctttgcaactgggtcaagatcaggcctgtctccttcttgatgatgagttgtctcataggaccctgttaagcaccatccccaaactccattctttttggtgaatatcccaacaaactccccagccatacctcaatgtccagacttgcctgatccccagggctggacacagaacaggctcattctgagaatcttctctctctccctccttcccattttgctcctcctaccaacatgagaagctagggggtctcatctttaaataattaattcttctttctttgtaagtattatacatgccaaacagactcttggtttgtgtctactgacccaacaaaagggctgtccacttgacggacaggcaacagatcatcttgataagtacatgaggcactcagatgtcaagtcaccaaaccttcattctgaatatttttgaggctcatgacagaccaaaagagccagagagttggggaacataatttcctttgctcataccctggaccaagaactgttgccaggaatatccatccatctgggggcttccagcttccccagatgcctgcgtgccttttgacccttctccttcccccaccctgcgagttcttcaacaaatactcttctaaaccaacatccccggcaaacgggagcaagacaccagcttttcactgatgcagatatttctgatcttttcatctcggttttatttctcactctcccactgcataaaagattaagaaagcactcgcatgaatgtttgcacatcatttaaatattcattttcattaatttattcatagtcgtaaagtttattgcctagaatatagagtcgtagaattttagagctggaagacaggagagaaatcatctagtttcgccgcctcgttttacagatgaggaaactgaggtgaagacagctcaggagaccgtccaaggtcagattctgaagtgagccaagtgagacccaaactcaagtcttggacagtctagcctctgtgcagcgcagctcagcacagctgaaaaccacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaattacacgttgtgataagggttttgtggggaatatacaagctcaatgtggagactagtggtgggagggcagaggcattttcccaggaagtggagaaagggaaggggaagcaaaagccatcccagggtgcgttagggagcaggtactgctgtggatgacgggtgaagaattcacctgggaaacttggggagaccatgtggaacatgccgtctctgagttatgccccatcagggggcaaagaaactggagtacttacccaccagatcctcatctgtcgttggttgaggactgctctcaggacattcacatccaggcacttctggtccacaccttggtacaatatttgcaatattagggacatgctaatacaattattcattgtatatgttaattcaaattaaatggaatgtcctatattttatagggcaaacttaggcttacgcctgggtggaatgagcaatccctgtcgccaaagaaggtccccagcatagcagttggctggagaaggaagggctgaccataagttgcactaaactgctctcagcagggtgacctggaagatcttggagtgtagatgtcaattaaggcaagtcctgagggctcggatggagccaacttttcacccgaggaggggaagagggagggttaaggagggcaaaggagagatttccaggcaaagtgcacattaaacaccagatgcgaagagctagacccccttaatgacaatttgctttctgtaatcttgaaccagggtctctcagtgtgtggaaggaatgtttgaatcggagtagcagggctgagtggcagtcctaaggcccagccacaacgtgttcttgacaagccatgtctatgtctggcgatgtgctcgcatggcacatgatcctgtttgacttcctgacagccccaggtgctggcctaaggccttccaaatgaggaaggaaggctggaagaagttaagtcatttgctagtaagggttagagccaggatttgaacccagatgactacagagttcatgcttttaattgctgcttgttaagtgcatctattatgggttgaattgcatccccccagaagatatgttgaagtcccatcctgttacctgtgaatgtaacctcatttggaagtagggtctttgcagatgtcatcaaattaatgtgagatctggctggattaagatggagcctcaatccagtgactggtgtctttattagagaaaagagagggagatttggagagacacacgtgtgtgcacacacatatctacgtatctacatgtatgcacatacctacatgcatgcacatacctacatgcacacacgtgtgcacacacacaagcagaaggccatgtgaagatggaggcagatactggagcgatgctgccataagccagggaacagcaagcattgccatccaccaccaggagctggaagtggcaaggatatgttctgccctagagccttcggagggagcgcagcgccagagacaccttgaattcagactctttgagttcctgaataaagagagaataaacttgtattgtttcaagccacctagtttgtggcactttgttatggcagccccaggaaaggaacacagcatcccctgtcaacaaaccaaggggagctaaagatataccctttagccaagtaaaccagctgccccgagcaggagcacagcttccagatcactcatcaaggggccgtgggtgacagggctggcctgctgctgcctttaatgggcgtagatgttgttgttcatgtttcccagcccattggtgatgacacagaggcaggagccggggctgcagactaaattatatacatctcaagggcagttagacaactagctcgcccacaggaacattgcaataagcacagtatctgctttcccagcaaagccaagtgcaagttcctgcctgctctgatgacctcttgtgcctccagtgtgggaagggaccaggtccctcaatgctgccgcctcccaccctgtgctgccacgtggatttaactccttcgtgttccccatgttcttagtcagtatggttgttgtgccatggattcaaatggggttgcttgatttgatttgccctttacttggctggaattctctctaacaatcaatggaaacacagctcatagggatgcatgtagcctgtctcatatgtgaaaaagaaactttcaatgtatacttcatctcattccaacaagaattggaaacagcaacatcaggacttatatggtgcagggtggtcagtaagtaggaaagaaactcggggcatggaagtgaacaggaagcccagagtgaagccaggacccaaaacccacaggtgctgctcttgttataagccagccacacatttgtctttgagccttttagcagctgccacaaactgggagaaaccatcagttatgcagtttacaatatctctaaactcaaaacaagccagtaattcagaaaaagcccagttcttctcacaaagaaagatctaagtgtgatatgagagtatatgcatggagaatattttctgagctggtgatgagctgcagggggcctctcccagcccccgcactggttgcacttttaaataagagaaaaaaacagtgataggactgacctgcgtgtagaagtttcaagttacaagaaaaacacttcacaggatccaaatccttaaagtcctgaaggaaacagagagcatatacaccagctttcgccacccaattcggatgtgttagaatgaagagtctcttattttttaatgaatttttctctatttaaaagtacagggatacctcagagatattgcagatcccgttccagaccaccacaataaagcaaatatctcaataaggcaagtcacatgaattttggagtttcccagtgcatacaaaagttgcttacacgatataatagactcttaagtgtacaatagcattgtaagaaaacaatgtacataccttaattttaaaatatttcattactaaaaaatgctaatgatcatctgagccttcagcaagttgtcatctttttgctggtggagggtcttgccttgatgttgatggctgctgatggatcaagttggcggttgctgaaggttggggtggctgtggcaatttcttaaaataagacaaggataaagcttgctgcatggattgactcttccttttacaaaaggattctctgtagcatgcactgccgtttgacatcattttactcacagcagaatttatctcaaaagtggaatcagttctctcaaactcgccactgctttatcagttaagtttatggaatattctaaatcctctgttgtcatttcaacaacattcatgacgttgttcatgacaatgttcagtgttcgccttcaggaagagcaagttccattgcaagaaatcactttctttgctcatctctaagaagcaagtgctcatccattcaagttttctcatgagattgcagcaatttagtcacatcatcaggctctacttctaactcgagttctcttgctatttctaccacatatgagtcttgaaggggctcaagacttacttcctccactaacttttgaacccctcagagtcacccaagaaggtggaataaacttcttccaaactcttgttattattaatttttgatcctttgccatgaatcacgaatgttcttaatggcatctagaatgctgaatcctttctagaagattttcaatttacttagcccagatccatcagaagaatacagtatctgtggcacctgtaggcttctaaaatgtatttctttaataataatacttgatagttgaaattactctttgatacataggctgcagactgggcattgtattagcaggcatggaaactacattaatcttgtacatctccatcagagctcttaggtacgaggtacattgtcaacaagtggaatatttttattttttttattgttattgttttgagacagcctggtctggaatgcactggcatgactgcagctcaaattatcctcctactccagccttcccagtagctgggactacaggcacatgccactaggctgggctatttttgtatttttagtagagacacaatttcaccgtgttgcccaggctggtcttgaacttgtggtgaatcaatctgcccaaatcagcctcccacagtgccacaattacaggtgtgagccaccacactggaccaagcagaatatttttaaaggaatacaaattttttcccaacagtaggtctcgacagtgggcataaattattcagtaaatcatgccataaatagacgtggtctcatccagggtttgttattccatttatagagcacagggagagtaggtttagcataattcttaaggaccctaggattttgggaatggtaaatgagcttggcttcaacttgaagtcaccagcagggaagagagtcagcctgtgcttcgcagctttgaagccaggcattgccttctcctccctagctctcaaagtcctagacagcatcttcttccaacagaaagctgttttgtctacattgaaaatctgttagtgtagccaccttagtggtcttatctagatcttctggaaaacttgctgcagcttctgcatcagcacttgctgcttcatgttgcacttttttgttatggagacggctttcttccttaaacctcatgaaccgacctctgctagcttccaagttttcttctgcagcttcctcacccctctcagccttcacacaattatagagagtgagggccttgctctggattagattttggcttcagggaatgttgtggctggtttgatcctgtatccaaaccactcaaacattcttcatatgggtgataacgctgttttggtttctatcatttgtgtgttcactagaatagcacttttaatttccttcaagaactttttctttgcattcacaacttgcctgtttggcacgagatctggctttcagcctatgtcagttttcgacatggctttctcgttaagcttaatcacttctagcttttgatttaaagtgagagacatgcaactctgactttctcttgggcactgaaaagccattgaagggttgtaagtttgcctaatttcaatactgttgtgtctcaggtaatagggaggcccaaggagggggaaagagaaggagaacagcaggttgctggagccagtgtggtattcataaatataacatttatcaattaagtttgccatctgatatgggtgcagtttgtggtgccccaaaaaatgacaatggggacatcaaagatcactgatcacagatcaccaaaactgatataataataatttaaaagcttgaaatattgtaagaattatcaaaatgtgatacagagacatgaagtgagcaggtaccattggaaaaatggtgccgatagtcttccttaatgcaaagttgccagaaaccttcgatttgtaaaaaacacagtatttgcaaagtgcaataaaaggaaatgcaataaaatgaggtatgccgataatacatacagctcagtgaagaatatcttaaaaatatttaaaaagaaggaagaaaatcactcataattctgctgcccatggcaaccacaattaacccatgcctgccttccagtctttttaccacgtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccacagaggggaagcattgctgtttatttatccatttctatgttgttggtcatttatatggttttaaatacttttggtgtcataaggagtgttgtgataaacatctctgtgcataaagcagtttctatagttcccattatgtctttaggatagattcccagaaatggaattactaggtcaaaggttgggcacattttttaaaggtttgtgagacatattgccaaattgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcgctccatgagtctgacactttgtaggtgctttataaatatggattgaagcaaatgagtgacgttcatatgatgttttgcagttttttcaaagtgggttttacattgagaatctcatttttccaacaaggcaactaaggcatggattcaataatgtgccagcggcacacacatagcaaatggtccagccacgaagagaacgggactgtccagccgggaggacagtatgcttttcacctccctctgtacccttctctgagaactgtttggtttgaatcatgatggcagtggctggcttctccacgatgctgttgtgctgaaccctattaacctcatagggaagacactaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacaycctgccrttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggccctttctgcacttccacagtacccgaagtttaggcgcccctcctgccaagagcccccattagcagcaaaatatatctcacatggtgcccagagcaaaggaccctgtgctagttttttgtggctgctgtaataacggcaaactgagtgacgtaaaacagcagagatacatttgctcacggtgttggagcccagacgtctgaaattgacactgcttctggggacactagaggagactttgttcttcgcccttcccggcttcaggtcgcggtaagcattccttaactggtggtcacattactctatctgtgcctccatggtcacttggacttcccttctgtctgtctgaaatttccctctgcgtttattttttgttgttgtttgtttctgagacacagtctcactctgttgccccggctggagtgcagtggcatgatcttggctcactgcatcctccatctcccaggcttaagtaattctcctgccgcagcctcctgagtagatgggattacaggcgtgcgccaccatgcccggtcaatttttgtatttttagtagagacgaggtttcaccatgttggccaggctggtttcgaactcgtgacctcaggtgatccacctgccttggcctcccaaagtgctgggattacaggcgtgagtcaccatgcctggctatctgcgtttcttctgtaaggatacttgtctttaaatgtaggacccacttggaatatccagaactatcgtatcaaaaaatgtttactcacacctgcgtataccctgtttccaaatagagtcacagttacaggttccggggagttgacatgggtatcctctggggcagggggcacttttctgcctaccacagatactgaggtgcattgctaattacatgagtacagcatttgtgaaaactcgctcatgatatcttctccatagtcgcagtcagtaccagctgctgtggaaaaaattttacgcattgtgtttacaacagaatatataacatggcttagagacaaagtgttttacttatggccagtagatggaattctaaggtccgatgtcggtttgccatgacttgggcattggtttctgttcggctctgtttacggggctgtgggatgggtacatagacactcgtctacttgaacttccagggactcgggaggcctgcagttgaataacaagagaccgtgctggtgagaggtggagtttgcagtaggatttcaaagactccatggagtccaaaaggtgggaggtgtgttttggggcatgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgtgggcaagcacggcatctcttctttctttttcttctttttctgtttctttccttctcttgctatttcctttctttctttttccttcccttccttccttccttctctctatccttcctttttgtcccttccttcccctcattctttctttccctctctctttctccgtctttctttcctccctcccatactctctacttttcttcttcccttccctttgttttcacgctaattccttaatttgtttttgggtctgctcgcaggaaataaccgtaagctaggataactgaggtaaaatttgtacagctaagctgaatggtgaaaggcccagatttagttctcattgtaggaaaaagggccagaataccttgcccatttttgccttgggaagtgagctcaatgaaatacatcttcatatgcccrttttacagaagcagcaactgagggctgttgtactgaggcttgcaatggccacctcaacttttaggtctctgaggcagcaatgggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaaggtttgggtagggaagcaacagastacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgagggcagytggggagtgaatctgtcgtttgttgagrctctttttcctgcttgccagacactgatctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaaaagcaggcacattataaagaattatgtcaacctgatttcttgaatcccaggacaattcatatccccgtgccatccgattagtgaatcaagagaaactgattgatatacagcaacaatagttaagaaacaggcagcatcgatggaggtttgattaaaccgataccctgggtctcctgctgtatcaaatcatgggcgaattggtaccattaggataaattactacaagaggcactgcaaagccaagctaaataaactctgccttctcgagcccctgattgtcttattaaataatttctttgcctcttaagtgtggactcggagcactcgtgctctgaaagccctcctgattaactatagccttggcctcaagttgattttataaacttcggatggtgccccagagggtgaagcttcctgttgtcaattctgcccgttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaagacagggcaggagggtggtgtggcacaaaggcggctctgtctgacctgtcacgttaggactgagttcattcttgttcagattcagcatcttttgttacacccgaagtgcattccatggccctgtcccagccatagaaagaaatgcctttatttttaagcgagacttcttgtggaatgatgaatatgttcagggaggctgttggtggcaagaaaagaagggtgatgggttgggcttatattgtttagtggagcaaaagagatgtgaaacatttgtgtcttaaagtgttttggtcargagaaactaaattggttagaaagtgtgcaattttgcaagctttataaaaatataaaccaatgagtctggactctgttccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactctgaaacctattttcccatttttttttttttttagggataaatttctcccaaactatatgcagatcctgctagagactgcccatccctctatccatttctcagtttgaaaagaaatcctggaattcagaatgatgaatattcattttaacatcatcttaaaatgtccttatagatgtatattacagctgtagtctgccaggccaagaattcgattggcatttccagagtactgttgattgtattttagaatcttccaaacctccgtaattgtcttgttgatttcaaacaccctgagaacatttcctaaatgctcatagcgtccaatagcatgggaaagtaaatggtttatgaggagaatttgggatgtgcaaaataagcctttgaagagagtgcattatctgaagcctgacattgtaacagcttcttaattacgctttctttcatgtggcatttttatgggatccagtacgcccaggctcaaatgatagacatttcaactcctacatccaagtgtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattctggatgatgtgatggggaaagaggatgtgagctgaggcttggaaccaagcagagcttgggctttggggtgctgggaggacagaatgctggaaacagaggtaagaagggtaagcacctagtcaacatgagtgatttagctttgggagctgatcaagtgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacggtgagtcaattaaacctctttcctttataaactacccagtctcaggtatttctgtgtagcagtgtaagaacagactaatacagcaagggagcagtgatggagcacaggctggaaaactgagttgaggggtcagtggtggaccctgaaggttagactaagaaatttagactccagcctacataaatgtagactccatgcagaatgactggatgtcctataggacatgcaaagccacagggaattttggaacaggaaattgtgctcaaagctgaattttgaggaggtaaatacagcctctgtgtgtaagacagagaaaaggagagagtgggaagtaatttatgtatcacagttgcctagagaagacagaaaataggtgcctggcttatgtggccactgctttttttttaaacttatttctttaattttatttttttttaaattaggattaaaaaatgtacatatacacataaaatatttatttttgaataggtaatacttttatatggttcaaaaatcaaaagtagaagataaaaacaaggtgtatatgtatatatatttatatacctatgtgcatatataaaatccttgtatacatatacacacacacacctatgtttttctttatgtgtgttaaaatctccctctacccctttcctttagcacctaattcctcttctgaaccgatgttatttcctggtgcatccttctagacattattatgcatttacaaggcaatatgtttgtatattcttctgccctccccttcactttgctatacacaccttgctctttttgcttgacaatatatcttagagatggttctaaatcagcatataaattatttcttcattttttaacaactgctgagtattacactgtgtggatgtttcataattcattgaaccaattccctattgatagacatttgggttgttcccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatggagcaggggagatgctgatgatttggttacccscttctccatcccccaccacccactgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgatcccattggagaaatctttcctatcacttccaatccacgtgtgttcagacaaacactaattttgttagtacaacgtcccctaatagctaagagttaaaaaaaaaataggtcttagaagtgtgaaaaacaaaaaacaaaaaacaaaaaaaaaaacactaaaccccaaatttgtccttttaacactttcagcaaccctgtaaagtcattatcatccccctgttacaggtaagaaaattaaggctcagagaggttaaataacttggccaaggtcacacagctattaaggaatggtaccatgtcttggacccaggttaactttaaatcctgagctttataacggtttgatttcagtagcaaatgcagtggcacagaagggtctgggcatttatttccaaagaatgatttcactcaactgaggaattctaatgttttaacagcatcctacttatttctaaagtgttggggtgaatttgccaaggtttgaaaagtgcatttgtaagccagtaggattcaatctgaagtcagggataacagagccgggggcggaggctaggtctccttacatattttgttcacaatgggactagaacactctgcagagtatgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcaggrcctaggattgsaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatggcggtttattccgaaagactgctgtatttatgcttaaataattaggattacctctacctggtatatttgcagggacaagcaaagcatacactgaaaataaattctcaaatgaaattcatttcacattagttgcatcccaacattcctttatggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtcaggctccctggagtgaagtgtaagcgtcgctgttcactggctgagtcatctttggtaggtccctttaccactttgccactttaagtctccgtttcctcatctgtaaaatagaggtaataaaaacagctaatatttacagagagcttactccttgttagcagttttcattaattaatgggtgtatttattggaataaccgtgtaaggttgccatttttatttccatctgtgtgttacagatgagatgtgtaatagaaagggaatttgcccaagctcacagtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccarccgaagagaccactgcattgttggccataartgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagggatgagctctcctctgcatgtaacaagcaaggtgattcagcaagaagactgctggtctctcccttcctccagggccatttgtgagagtgagacacaaaatattagaagcaaaagaagaagctgtactcccaagaggcatggatccttgagtgagttatgtgcttggaaaaaattagtttgcacatgaggacacaaagagagcctgaaaagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacaccccttcctacgtcctacatccctgtacttggaaagcaatcatatttaaatcattgctgctggaactttagttgactttataagttacattttacataaaaaggcagcagtggtgaagctggaagagggcacctagrctttgatttcaggcaagattttgttaggtcccagtattggracttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattkggaggtagtcttttcaggaatattctgagtttgtttcttgatctcgatagcagcaacctttccatttgctctctgtctggtttctctgtgtctctctttttccctcaaacatcgcttttctttttttaaaacaagaataaatcccttaggaccttgctaagttattacttatattgtcgcttaaaaaaaactttggaaagaggctctggcatactttaaaaaagttaagcacactcaagcctctttaattctaaattcagttttgaatatgcttgtactgatgtcaatgacttttcaaaagagagtgtcccaattatttaggtggccaagagaaacagctttaattctttatcacataaatatgcttcaaaccacgatttaaaccagatggatggagcactggattagtggtggggcttcttggctgatctgagtttcgcctcctcgatcttgcctgggtctgttctgtcacttggatcttaccagtcctggcaggcacacagctctgtgagattttccttctggctttgcatgaagcttttgaaaagaaaacacatacatgcaagtgacctttctagggttgtttctagtttcttcgtcttacataaagcccctgctaatttagcatggtgtgtgcccgagtttattttctttttaacaactttatttatgtaattaagcgagtgaagtcatacattttattgatctaatgaaacgcatttcatggttcctcctgcccttcatcttctgaccttccccttcagatcacagccctttactttcgtcaatgagacgccacttaacaattttccaccttgccaaatttgaggtccccctcaacattaacggggaacccaatatcagttccttaaatgggagcaaagattgatgtcaatataaactaggacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctrctgtccttgccsgtggcctgcactggggagttgtatattgtatcagtaattttaaaagccagcaagtgttctaccagctgaagaagttttcctaatggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtggagggaataattgggattatcttatgatttttttttctctttaattttcttacaaaggaaaaagaaagaatccaatttgttataaataactgctgagggcagtacatgttgcaggtagtcactatctgggactggtggcacaggcagtaaaggattcaccaagacagttgtaggtaaagaaaggtggatttattggagaagataagaaagtacactgtaaggttgcaacaggcagcccagcatggaaggggctgtctgcaaagaggcaggggctggagggactgaagttatacagggtcctgttggagggagctatgtgcagaatgaggtcgaggtcattgtgcctgcggattgtttgttgttcttccctacccggggcccactcctacctggggcctcttcctcattgctgcttacttattagaactccacagtagattttttataaatgcagacacatacagacacccacacccacacatacagacacacacagaaacatatacacatttaggtcgcgatttcttcacaaggacattcttatagacatgtcatgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtagcaaagtggagtgaatgccaccaataatgagttccaaacagggtatgtgtttgcagacaggagctacatacatttgaaaattaggatgatttgaaattgaaatgagggcttatgctgttcattggattaatttttctctcttataaataaaaaatatatacaaataatacataaacattgtttttcactgtggcttgaattttctaacaatttttttcttcttctcaggaaatgttttcttcttatacctccaaaataaccactgttgacagtgtattgttaaccttgctagaaaaaaatatttatttttgatccatacacgtaaatatgcatactcataaatatgcattcatattttgtgtatgagtacacttgttaatttacatgtatgtcttgatttatatacattgttctatacctttccttttcccataattttatggattacatttattttcatttctgtatatttagttaattcttttaaaaggctgcctgttatcccattgtctgtcttcaccatcatttacttaygtaataaatctgttaaataattttaatataaatctattcatctatccatctattaaaagagatttaagttatttctaatctttgcrtattataagttgcatttcagcttataccttgactttctttgacatatacatcaataggtagagtatattcctagaaattcaattgtggaccaatgagatgtacttcaaatttttaacagatatttcagtattgacctcccaaaatgtattcacacacccaccaaatctaagtgtctgtgtaacacacagatgctgatttggagtattaccattttaaaaaaataatatagctatcagtcgtgtaaaaaaaatcctcaccattatttcttaattttacattgtaattgtgagtgatgttgggtagatttttgtacttttattgaccattcacatttcttcttttctgaactgcctttccatattctcggtccagctttctataagattgctctcatttactggtgakagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgartttggcagaataccatttaagtcttgtattttccaaagytagtcaacrtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccctggttcaagcgattctcctgcctccgcctcccaagtagctgggattacaggcatgcaccatcacacccagctaatttttgtatttttagtagagacgggattttaccatgttggccaggatggtcttgatctcctgacctcatgatccacccgcctcggcctcccaaagtgctgggattacaggcgtgagctaccatgcctggccctgatgtcacttcttaggctaatttctgtgaaattgtgattgggaggaaaaagtgaacaggaacttaaagccagcagaggaaagctacctgcccttsactggtggtcagtgcatggattccagagacagggtgggcaccagttcctcaccgggtcctttctagttgcatgacctggggcaggtgactttatgtggctaagcctcagcttcctgacatatggcaggagtaataatatcccttgaagccaacaaaattcaataggcacatgccatgtacatgcctgtgttatgccgggaacttcttaacatttccagaatatgtgtaatcatatttgttacatgcaatatgaaattatgtgtaaactgtccaacctgcaggaggcagtagatcaatcaattacatgtgattaatcctccccctatcttacagagaataggagagaaaatagagctccaaggtggaggaaaagacaactgagaggaggctattgtgatgttttattaccataaactgccaagggttagycgtagccctccatctgccagctaattccggtttcattaatatgaatattctcacgcttccagaaggaaattcttggaatgttatggatctctgtagcaggcacatgcaacgtccagtgcttccctgctggtaatgtggcggttttattatgcatgccatacccatgctctctatttcctcgatagrccttatagaaatcaccatgcttccttttagaagaaaatgatggtatcacatggagaacgagctgaggagcttgacaatcttggcaaggcttatcaaaagaaaattcatgtgttagccttaagttaacactacttttattaaattcagtttttatcacagctgataacttggagatgtaagcatttagagacagaattcacttatgaatgttctaaaatgtcagaaagtttaggattctcttcaggtagtttcctttctctcacttggagtgacatgttggacccgtggcattgtcccgaggcaacgttgtggaatttttagagagtgtttgtctgttagctgtttgttttgaacatgttcacctttggctctgacctgccatcatggaaaaaaagtgtcaatgtgttgggaaagaaatgggctgcttctcttttctcctccctcctccgtctccttcccccgaccctcctccatccccttcctgcccccactcctcctgctctccagcctggcctctgtcccctctgtgttcctccccttcttccttgtatccttaatgacttccaggtgtgcctgctgggtcaggcttctggccccgtcctggggaggctgggtctgtgcctccacaaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctctttcctgttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagcctccagagggtgagactgacatctcatttctctttkcagtcacagcagagatgcaggcccacagtagggactcaccagatgtggcagggtgagggaattgtccatagatgccttaaagatatgctatccacaggagcagagagcacagcaggctggatgccaaggagaattcgaccagggtaaggcttacaggcaatccattcagtgcagagtcttcccccatccacacatataactccctttagtattgatgacctttctctcctgaaatattacagaaactgccctgaacgaagatagatggtcccccctcagcgttcacacatggttccgtctcatccaccagcttccccggccccattccctctgtctcaggaaagtaataatagtaactcataataatagttcaaaataataataatcatacctgggatttatatttcagcgtgcctcctaagagggcaaataaaccattttacacaatgcagagagaaggacagattttctttgtgctgctgctgatcacgttaagccaggagagatttacagtcaaattccagctacagaagcaaagtgttggtgccccgttggcatgtggggatccactttaatgttgttctcttggttttgcttaaactgccaagtgaattactgtaacacactttgcctgcagttaatttgacatctagtgccagagagctgctttatatttttcaaggcaagccagggtgaaatttttgcaaaaagatttgtccatcatttttactgatgtccaaacacgatgtctttagcttctttggaatcgagctgtggaagtcacgtgggctttttcttttttcttttctttttctttctttctttcttttctttttttaaggatcacagaagaaaagcaggccgatcttgttgaaatgtttttaaaatctccaaataataaaataggtttagggtgtttgcttatgaaagctgactttcaccagaatgatttatatgcatcatgggcagaggggcagtccaataaaagaggcagaaagggctcttgaaaaatgtccctgggcacttgcccgaatgactttagtgacagtatctactaaaactgataytaattctgttacgtgttatggcgcatacccaagaccctccccataaactatttgaaagaagcaaagttgtaattctccaaatacggacttgtacatttctgatcattttagcaccaacattggttcaaactctggcagccgaccacagttccagctgagctttgctgcgctgtcagcaccatggggcctgataaagcatttttggatttttcctactcacagtgcccccatggtctcaatgctgttgagaacattaagctccttacctgtgttttgtggttgttgttattgtttttctttctggtaaaggactttatctgcagtcctaacaaattgacttacgttaacattctaactcgtggctaaaccaaaaataaacttgcagaccctgccctgaaatgcacgctctgagcagtctattggatgcggtggtgtggccgatttcttggacttgctacattcttaggcaagtgacatctcccttcatttgtacagagggagttagaattgaatcgaacttccaccgcagcatccgccagctcttataatcacttgccctttgctgatggtgagtttttagctgctttctctcctaccatacagcactgacacctgagaagtccagtccttttggagttcagtagattccttgtctctggaaaatcagcagaaaacaatgcagcctcctcttgatctcccctgaactttgcaaacctctctcagcattgaccgcatgaagggtgggtgccctgaggcaggcaagccaccaggtggtaattaagaagcaagaagcgctgctcccaattctctagatctggatttagaggccagttggcttcagaaaacatctcattcacacaaaatgggacatggtcttttgtctgttaaacataagctttcaaggtgagttgtgcagaggcaagtctgcttgtttcatcaagctgacgtttatacttctgagtaagtagggggatccggagagtcttcttgtcactcaaacagtttccgtacgtcagtttcacacctctgttctgcatgtctctgttgggaaggatgctgatgtctgggatttgaaatagagatggttggacctctgactttcaacaggaggaaatcaaaattaaaggaagaatataggcgtacgcttagaaaggacctgtgaaaggaagataaatcttgggcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaaagaagtttggggtgaaaacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccgtctagcacggagggccagaaggaagcagtgtccattaggatgactcttcagtgcttcttggcgttgtgattagcccgtctaacagggcgggccagaaggaagcagtgtccgttagtatgactctccagtgcttcttggctattgtgataagcccgtctagcagggaggagatgtctacacggtgttctccaaactgctcagaaaagagcagtaaggacaggatggggcccagttaagaggtatatatcttaccttctctttttctccttcttctccatctcctgcccttacttcttcctgcctgtcatttatttattcttttcacagatatttagtgagtccttgctctgtgtcaggccacagtgtagatattccagggatggaggtgaccaagcagacatggccatagtgacaggctaaggaagcacaaatcacaaatacagaagataattcctggtagtgacgggtgcctccaagcatataaaacagggtagtgagatgggaagttagagtagaaatggctcaattttgtgctggaactggctgcaccagcaggagccaatgattacccatctcccatgtttagtgacatcatgttgatagcttgatttcagccatagtgagaatattttcaccacggaaattggcacatgctacacatcagggctccctcctccccaccaaagctgatcattaaacattttctagaacatacctggaaggcatctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgkttttgttttgtttctttttgagatagggtctcattccgttccctaggcgggactgcagtggcaccattatggtttactgcagccttgacctcccaggcccaactgatcctcctgcctcagtctcccaagtagctgggactacagggacacaccatcatgctgagctaatttttatatatatttttttacagagacaagttctcgccttattgcccaggctgatcttgaactcctgggctcaagccaccagcctgcctcagcctcccaaagagcagagattacaggcgtgagctaccacacccagccatttatctgttttttaaatagcattttggagatgacagaaaaaaaaataaaggaaagagaacgctcatagaagtttaaggttcagaagtatttggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtmtttcttgaattttaactgtgcctgaagatcartcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgtttcacaccctatgtcttgtgtgtggtgactcatttgaaccttatagcagccctgagggataggtgccggtttgtctctatgcgcccatgggaaactggggcacagaggtgttaagtaagtgacccaagaacacacagctggtaggagttttagccaatattccagtctcgatctgctgatatgaagccgatgcagctagccaccatgttatacccacccatagtcatgaaaataagatgagcttaatttttttcttttgagactgggtcttgctatgttaccctgggtggagtgcagtggcacagtcatagctcactgcaatcttgaactcctgggctccagtgattttcagcttactgagtagctgtgactacaggcacaggcctccatacccagctaagtttattattttttggtagagatggagtattgctatgttgcccaggcttgtcttgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatagatgggagaaattaatagcacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttawttacagttttggtttccaaggtttcagttatacattgtcamctgtggtacaaatatattacttacaataygatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggwcttggagtatatcccctgtgcagaagcggaggctactgtayatacatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaaccaacgaaacagcaatacttgtaactaaaattgggagaaaggaaaacactttcagtagagtcaaggatttttttgttaattatttttatttttagagatggtctcactatgttgcccaggctggtctcgatctcctaggctcaagcagtcctcccatctcaacctcccaaagtgttgagattacagttatgagccaccgcatccagcccacaagtattattccaaactgtaaaatcgtgaaatgttttgcattagaatcagaaactagacaagaatattcatgatagctgtcaattgtcacattattttagaagttttaacaaatacagtaagacaaaaaaagtcttaagtaatgggatgaaaccaaaatgttctttgttttaaacttctgtaattataatcctagagaagctaaaatattcagtaaaaattactagcaatgaaataatttgaagagttggctagatgtaaggtaaatatacacaaattagctggtatatactagttataatttaagatggagatagaaaaaaaccccattcaaaatattaacacaactatcagatatttaagaataaatgtataagagtgatcaaatacctgtattaaaattatataatttattgaaaggaattttttgaaagtcacccataaaatgatataattttaccataaaatatcagctaaaaagggggcagtcagcaaaagctcagctgtgaattaagattattttctaacccttagttctttgataacataaataccggtagaacttggaatatttcaagtaaagtaacatgctgtgttttatctgtattcctggtaacttgcatttttcaaggaaggaagtgtatgatatgaagtaggcttataatttagtcagatgagctcttggattatgttaccttgaatataatgcagaggagaaaacaaaaagagtcttttgcatttttatttcttatcaataggtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagtagaagggtcttgagatttggagtcgtaacgagttttcaaaactcataactatattacagtttgcgcaagtcatttaacctatctgaaccttcatttcctctcccacacaggataaaataaggataataacagccattttagagttcgtattaatatttaagtgggagaatgcagccagtaccctgagaattaaggttcattcactcagcaagtgcttactaagcatctggtttatattatgggaagttttgagaattaggtggtcagaaaggtgtggtcctcgccttcaaggagcttacattctaggaagcgaagactactgaacaagagattttagtgctaggattggagaccccagcagaagtagcaaatactgtgtgaggtttaaggaggttggaggcaccttcgcttgtacttctacatgtgtcccttcatgtctagttcactgattttttaattgaaattttaattgaagactcacatgtagttgtaagaaataatatacaatgattcctcatattcttagctcagtttcccccagtgatagcttttgcaaaacaattgtgcaatatcacagtgttgacacttacagaatctatggatcttattcagatttctcattttacctgtactcaagtgtgtatatgtgtgtctgtgtctacatatgtagttttatacagtgtcatcaaatgtgtagcttcctttatacacaactacatcaagacagtgaacagtgcatcaccacaaaattcccttgcgttgccttgcaaaccacacccaccttccttctgcgcctgcctcatccctgacccctggcaaccactaaactgttctccacttttaaaatgttgttttttcaaaattattatataagcagaatagcatagtatgtaatcttttggggactgacttttttcactcggtacaattccgtggagattcttcccagttgttgcacgtgtcggtagcttgtttaatttcattgctcagtagtattccatggtattgtacatataagtgatcgtatgtttaatcactctcccgctgaaggaaatctagtcttggctattgaaagtaatgctattataaacatttgtacacaagtgtttgtgtaaatagaagttttcttttctctgggataaatgcccatgaatgcaattggtgggttgtagggtaatgacatgattagtttgtataagaaactgtcaagctgtttccatgctattttacatttccaccagcatttggtgatctagtttcactatatcttcaccagcatttggtggtgttgcagttttttattttagccattctggtaaacatgtagtgatatttcactgtggttttaattaaattgccctgatagctaataattttaaacatattttcatttgtttgtcatctatatatcctcttcggtgaaatgtctattaatgtttttttctcattttctatttgaattgttgtattattgttgcattttgaaaattctttatatattctagttattggttctttgttggatatgtggtttgcaaatatcttctctcaatctacagcttgtcttttcatcatctttacatggacatttgcaaaataaaagtatttagttttaatgaggtccaatttatcaatttttcctttcatcaactgagcttttgttgccaaatctaataattctttgggtaaccatatatcccaaataatttctaatatttttttcctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtctatgtctaccagaagccttgctgcagttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgascttgctgattgcatttattataaagttccaggagttttttatttttgtttgtatttgttagtttttttgagatttcttgggattttctatctagcctgtcatgtcatatgcaaatagagaattttatttcttcytttrtaatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatawgattttcctttagctttttgrtatggtggactatattgattttaaatattgaaccagccttgaagacctggaataaatcccacttgstcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgcataagaaccaatgagcatttagtttcatgtctcataaataatctgcctgcttatattttcatctgtacttctctcagctggcattctgccacagactacatttaggaccgcagccagtgggttacagcaggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatgccgatgaccagtaagaccacatctgtgggcacaaaagagcccatttatgttttttatgggaacctaagaaggaaatgcttttctggtcaaatacgttcttctctgattaggcctctcattttaaggcagttgagaagactcacagatgtgattcactggcaatggctctggttcaccaagcttagctctgctcagtctacctttagcagaagattaaaaatgaaaactcttcttgttagaggtagaagagatcctttcccaaaccatagattcatggaactgtcaaagagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattattgacgtccagctgartgttgccacgtggaaattagctataaacttgccagaacctccartttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccagttggagtgagccaaataaaatacatctgcagtccagattcaacctgcaggccatcattctgctgtcattggtgtagaagactttttcagcctagtttattctaggctcttttcatttctccctgatttgaggctttgtaggacgttgcacaggaattatttcccttttaaacgttagttttcattttaccagtgcaactctgctattggcacatctatgaaatacgtaaagctatcattttaatactaaagaggaaacacaaatttgactcatttccccagaaaattcccctcctgctttccatatgttatatagttaactgtaaaagtggcaccacctcttaaacagccagctattctgatcatttgaaatctggaacattctttcctacggtggttgacttttcactgcctttgaggttctttccaagtaaaggcgttatyctttgtggtgtgctcctggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggygacaragctgagacctcaccctctgcttatgggctgcatgcctttctcagtgaaataacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaaaccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaagcagaagttgggaatcatagaagaccttgatgttaccatatcccttgttaaatttcctctaatactattgagaagtttatcctctactttttcctgtagagtaaaagatatcgattttgtttctgtcggcactgccttggaacttgcttgcatccctcccccacgcgaggcgaggccctgaggagcgggattcgctgacccatgctggcagaacgggtgatggatgaggcagagaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgggggaaayacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtagtggcttgcgaaaagattccagcactaaagtttgaccccagtcctacctgacttcctttctccagctgtgagactcccctgtacaatttttctggagggtctagagtcacatgagtcacgccaagccgccctttcagtgcgaaggaatccaagcagagccctcctctgctgtgggtacttacttagggaactgtggaggtgtcctcaggtagccactggtgtgtggggtcataccaagtcatttggtttacatcgggaatgccttttgtcgttatgtctagacccctggagaacagcccacggcaatgcacttstggaaattcggactgtgrattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttgggggggkttttttgttgttgttgtttagctgtttatgggtaggagaatgcgtgctcttttagggacatctcttcaaataagaacaggttgtaacctacactcaaaagagatgctcttggcaaggtatggcccctaaggtttgaaagcgttttccaggcctgctgtcaggccaggctggactgtccacaatttcttgtcctgcctcccgtgatgctagccatggatgcaccccagaagcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagkatttgtgtaagtgtcctctgccctggacaccrgtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccaywcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttgatccaaggtttaggctctcagtgcctgtttcctgtttaatacatatcatggttttggaaaaaatgaaagaaagaaagaagaggaagagctgtcattcctctgacaagtattttcagtggaattagggtcatgatgtcatgcttatttcaaaagatagcttcatctgtgccttcacccagacttagggttctagattcttctagattctacagcaggcactggcaagcttttgcttaagaaggcaagccgggaatggtggctcacgcctgtaatcccagcactttgggaggccgaggcaggcagatcatgaagtcaagagatggaaaccattctggccaacatggtgaaaccccatctctcctaaaaatacaaaaattagctgggcatggtggcgtgtgcctgtagttccagctactcgggaggccgaggcaggagaatcacttgaaccagggaggaagaggttgcagtgagctgagatcacgccattgcactccagcctggcgacagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgycttataccagtggtgcctagcatggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaaggtctcactctgttgcccaggctggagtgcagtggtacaatttcagctcactgcaacctttgcatcctgggctcaagcaatcctcccacgtcaacctccagaatagctaagacccaggtgcgcaccaacacacttggctaatttttgtgcattttgtagagatggggttttgccatgctgctcaagctattctcgaactcctgacctcaagtgattcacccgcctcagcctcccaaagtgctgggataacaggcgtgagccaccgctcccagcaacaattgcagtttttaaaggcagaaaatattacacaggtgggttcaaatttgccacaccaagtagaaggtgttggaaggaaaattaggaattcttaagcttcagaagattagtagtcagagttaaaaaccagacaattaacaagttaaaaaaaaattgtgaagcacacacagctgttatcttccagaaacactgcttacagaggtaattgctcacagattttagggtttacagcaggtatcacaggatttcaaatttaaraggggggtgggggcctgtgttcaaagtcttaagaatatccaagggatgtatgatgtatgcataattacctgaaattgaaactactgtagtttaaacacttgctgaaagaagaccttttatttcatcttctctacaggctgaaggaaagaaaaaacaaaactaacaactaacagaaaaacttttcatgtcgaatatgtagatttacaatatgtgaattatcatcagaagaatgaggttctttgatgattgttgcagataccctgaagaactggcccttgttgtagaagaatggcacagggcacatggtaaaatggccctggccattcctttagacattttgtttgtacttatattaacttgagagaaagtattaggaaaaacagagtaattctgtagaaatattcctgatgatacactaggcaaagcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgctatgtcagagtggagggacatggggaggcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgattagaaagggtggatggtggcctggggcatgagaaataaaggaggtggtggggtgtaagttctggattggttgggttgcattcaaaaggggtgcccccaagtgagttgtttgctgcctctaggaatttattgaccctgggaggggagatcccagatgtcaaagcatgggaggacagaaaagaaacagcatggttcccacaagagagaagtagacagagacctctggaagtttaaaaatatatatgttgggatttcatagatgaggtgagcaaaaaattggccgggaagaactattaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacatctccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgtttattttgttgtttattcatttgcttgtcatctgtattttcccactagaactcaagtttgtgacaacaaggacctaggtcattttcactgctgtagtcccagttcctacaacagtgcccaggacacaccaggaacgtgacatttattgaatagatgaaagaacagtgtaaaaaccacattgctcttcactctgcctgcagccaactcaagaacaatttcctaaagcagctctgaaaattacgaaagaaatagtgcatggattccagccccagtaggcttctgggcttggtgtttctttaatttcatgtaaatttctctaagtaaatatgccttaaaagtgaataaaattttatttcgctttaacaagagaatataaaagttaaaaaggtcactgtagtaatagactaatctcaattaccagggcagcctctgaaaccctcactcccacctaatctcattcggtgcatacgcagctcaccgtgtgatttccaacacagctaaatgaaattataaagcagtgttaaatttattaatcatttaattagctaaatgttcctgcaagtactggctagatgaatggcatgtcattttctaatgcaatttgcctctcaggcagccagggtcagaaagggaagctcctggcatctcgaatgagctctttatatcacaccttctactgggagacggttgttataccactgattatatttgagacttgtacacaagaccagggcactcagatgctggaattggaaaatgctctctttcttacctgggttacaaagaggaggctcagggtagctgatgagtcccccagagattgtctctccccgtgtccccttgcaggacaaatcttttcatatttaacaagccactgagcagaacagggggaaagatagcaggcagtattaaacgcatgctcaatctagttttatttcttcaaatttactcagtcgagaaaaatttgtggagtgcgaattctcctcatgctaggtgactttctaatccttctagttgagtcaggatttatttctccattctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtctgctgctgggtgctctgtgaatctgttcccatttgcagtgagagtgctggcatcaagcacattgtctaaattcactcggcaagaagccgttggagtgggtgccacgtgaggccgagaacatccaaatgaacactggtctgtttgttcaagatgggagctgtcagttgtgagagctcctatgggaagagtgttttgatgtatagacatccctggtccacagagccaccaagcaaggcagactatttcgtgagaaagaaggaagatagactccatgcaacacagtgggtgtggcaccaagcgggaggtggagggttgctacctagtcccggctccacctactgtcacctgcattcccctagacaaatcacagcacctcaggatccttgatctcatcatctgtaaaacagagatcagatgaaccctcgatattaatatcaataagagccgatcataggactgctctaaggattaaatacaatgatgtaacctacttgaaagtgtcatataaattctgaggtgaagtggaggcattatggatgcattttattttgttttattttatttcayttattctttttttgaagaggtatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacatacacatatacatatacacatacaatacatatattctgatacacatatgtacatatatgtgtatacatgctatatataatgtagcacgtttcctggcaccttgtttggttcaataatgttgctgggattatactacaatttccattactctgactatggcaacactgctgatataggagatcacttttccgcacaaacacctctaggtattgtttaacacagacctcatgaaataggtttgccatggattagataaggcaattctggactcacttccaggatagaaggcaaagacaagtaccaatatatttggtaaaaatatgacatgacatttgagtgcacacaggcaagtgaaggtggtttcaaatcctccctctgtcttttcccagctaaatgaccttgtgctggctcctcacctcctaagcctcagcttatctctaggatggacgtcattgtactcccttcatcccacctaaggttgttgttaaggatgaaatgaaaagtccacagcataagcttgacacataaaataagcacccgatgaatactgactaaagagagaggaggagtaggggagagaaggagagaagagaggaaatgaaaatgtttctgaataagttatgtctaagttttttcactttttattttttattgttttcaggacagggtcttgttccattgcccaggctggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcagtccacccgccttggcctgccaaagtgctgggattacagacatgagccacctcacgtggttgagattttttcactttaagaaatgctttttctgtcacctccctggactgtcttggatttgtttctttgaggggaaatatgaggctttaattttccctcccaggccttggaaaggccaagagaagcctggagataggaatccacctacacagagtgtctcagtaaattggcagtggccaggaccagaaccaggacacctgtctcccagatctgtccttttcttggatagcttgaagttacgggtagttattgaattggtcactggctaccccctgaatcattacctgattttttactgagtgttcctacctgtgagtaaagggtgcctggttttgcacaagtgttttcttggcccaagagatatttttatatttgcctttgggttgatgagatgctggtatgtatcattcgttcagccattctttcagtaagtcatcacggaagtctgcctctgtgacagattctggggctctaaggmggaatttacttcttcaaagtacagtttcctgccttgcaagtttggagttaaggccacgcagaccagagttacgtgcacaggttgtaatactctctcttgtccctggttgcctgattcaagttaggggcttcttctggattccgtaggtaggatgctgactctcagctgtcctgatgccactggtgttcctctagtaggcaacattgatggtaaacatagaaagtcatggaaggcctcagttacctctagccctgaagacacagggatacccttggggcggagaccttagggacaggacaataaagatcaggccttgggagatgcaaacagtttgcccttggaccatgtcttctgctttcatccttatgctctcaacagatcatgccaaggtcctgtgttcaccgcsttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgcttatggtttagagaaagcgcctttcaacagtcacatgcaagtattctttcaggcatttatccaaacacacaggatgaggcctctttgtcaaaccagtgtttgttgacaagcgacatttgtgtgcaggagatggctcattgtgtgtgtttacttggagctgttatatatgctgggggagacactgtgtatacaaacctaggagggagagattgggaggagggaagaaagtgaggaataggcttagtgagaaagagaccagagaaagagaaaagaaataaacattagcagggtggttaaacatccaagcattgaaaactgcgtggtggagctatgtactaactggggggtcttgaggaagcccattagtctccctgagcctcagtttagtagaagtaggaatcgtcattaaggcgcctcatttatgaagttactctgagctctataagagataagcatacagaaaactttggacagtgccttgcacacagtcagtaatcaatgcatattcatcatgatgttagagaaaggccgggcatggtggctcacacctgtaatcccagcactttgggaggccgaagggggtggatcacctgaagccaggagttcaagactagcctgcccaaaatggagaaacgccatctctactaaacatacaaaattagcctggcatagtggtgcatgcctgtaatcccagccacttttgaggctgaggcaggagaatcactggaactgggaggcggaggttgcagtgagctgagatcgtgccattgcactctggcctggacaacgagcaaaactccacctcaaaaaaaaaaaaagagagagagagaataaggtcagagggggaaaagagagaaagtgaaagcaacagtaaggaagagaattggaaaaaaaaaaaaaaaaaaggaactgatctggctgtatctgtcgagttgcttctgccgtttctagcccagcccacggttttccctctgcagggtgtctgtgggcatggtttgcaaataaacagtgagaagtataagctaaacatagactttaggcatatacataataggcaggcgtgatcgcgttcacccattcagtttgccatataaaagcttttcctcggtgccactttatggcccagaaacaaggctacaaaaactttaatactgctttttattttatagaaaaatataaatcaatactttcatgtctgtttgacgtgtttgggagctacagcaattgaggcttgccagtgtctggatgccccaccactaccacgccacttagctcagagtttgtttttttccttccaccatgtgaaatgttgctggttaaccagttaaaacggggagatggccatgattgcttttagattgccacttccacattgagtgaattttataataagaagccattttttccccgacaggctgcccttgtgcccgcctctctgactttgaggtcctcattattgtgggtttaaatgaaggatgttcattcaggcagggatggggggatggggggaggccaccaggcatcagcgctgttatcaggaccttctatcaggccaagtgacaggcgtccagagcaagaatgcagagctcatggtggagacctccggctgacaccaaaggtgactcccctcactctaaccttgaaagggaaagttcccactttattaaaatgaatttcgaaagggccgctctgacagctgcataattaaatactggagtgtcagcgataatttattccactcgcatgtggtggtcagatccttttcactagagggtcagcaaactcagtgacagaggcaaggagacaagggattcagggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaayagaatcagagcaaattcagcatagacctccttgggatgtttwttctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaastagcacacaaacccagtccatsatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaarttaatgtcattttyataactatctgcatttcaggtacagtgatctcctttaaaaaggctgcgtcccagcagcatagaccarctttacctcccagcgtagtcttcagacaagttrgggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagtttgcagcttttcttcccttttgcctcctctttagttcattccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactrtgtcaggtagacttatttttcgagttgtgctggttaactgcaatccaagtttaggaagcaaactaccaatttcatttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataaagaccagttgaacaaataaactatttttccatgtattaattctttagtgaacttgcttatttgttcagaagagacattaagctaagtatacaacactcggtaaatttcaacttcatcatatatataataattatttttttttgagacagagccttgctgtgtcatccaggctggagtgcatggcctgatctctactctctgcaacctccacctcccaggttcaaacaattctcatgcgtcagcctcctgagtagctgtgattacaggtgtgtgctaccacggccggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccatcagcttaaggcagcgaagcgaatgcccacagtgcccaagtcacttgcccaaggttatccaagtcaaataagacagagatgagattcaaattcaggccacaatgacttcaaaaacccttgtatccttgttttgtttcgtttccctgcaaacattgttttagttgagatgaaattcacgtaatatacagttaaccattttaaagtgtacacttcagtggcatttagtgaactcagtgttatgccaccgtcacctctttttagtttcaaaactttgtcatcaccccagaaaagcatacacataaagtcatcactgccccattcccttcttccaacttctctgcttttggtctctgtggatttgcctattctgggtataccacataaaaggaatcaaagaatatgtgaccttttgtgtctagctccgttcacttagcatgctgtttccaaggcttgtctaagttgtggcatgtgtcagtactttattcttttttatggctgcatagtattccactgcatggatataccacatcttgtttatctgttcatccattgatggacatttgggttgtttccgccttctaggtataatgacttgtgttgccataaacatttgtatacaagtttctgtgtggacatgttctcacttttcttgggtatatacttaggggtggaattgctgggtcatatgatcagtctaggtttaactttttgaygaactgacaaactgctatccacagtggctgcctgtaccattttacagaaaatctctgcttttaatacttctggatgtgttctaaggcactaggcttttcattaagttcatttctgcagaaagagttaaggagtgttctcaggtaactataatcaacccccagggacttactcaagttgtgcatgtgcaactgaaatatctggcaggcatccagtccctgttatttcagtctctccccgcctccctgcccacacctctgaagctccatattacccaggaagggacaatggggggcctagaaatgtggagggaggcaagagagtgataattatgccatctacacttgtcgactagaatttccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtggcctcgagttccttaacattttttaaaacaaaaaacttttgcatgggaaaaatccctttagaaagttaaaggttttccttatacaaactatctcactttgaaaactggcccactgtaaaaatcttgattccggagcttccttaaaaatcttttcacccctttaaagtgaaagttatggagaatctattagatacaaattaatacgggcaaggcgtgtgctagctgttttataaacatgatcccacttaatcctccacttcacaattctgaaaagtcaacaaatttggcccatggtagagaggaggaaaccaagacttgaaacattaaataacrtgtccaaagtctcccatttcagagacaggggcatttggctccaggtttttctgactctagacagtagtttgtttttagcacatcaaatktctgagacttgtgatgtgtyagaaagcacaaaggactttgatcacaagatcaagccccagagggccatgactgcataaaccacaacaactgcgtggctgcctgtcacgtcttcatctgcaagttggaggaacttggagaaatgcagtgcttccctgcagctgcagagggtctcactgagcactattcttggaattcttaaaagctgggcctgtaagccttttttgcatttcctttcagccacctcctggctgtccttttaaagccagggtaaagtccccagcacccagaatcaaggatggggaagaggaattttgagaatgtgcttcctgcttcacacaaatagctaaagacagaaatgatggcacaagccctaaccaacaactaggaaggtaggttgtccaagacaaattgcagtttagaatggacctgccaaatgggtgggtgggcaggatggctgggatcgccagtgcccaaccttgccacagcctccttttgtcactctagggactacccttttcctccccagacgtttttcctgactctaaatagtgggaaaagtctggtttgagattgctgtattgcagggaagttcttacagcgggcttgatgggcccagaaatcaagatggaaaaaaacaaccctctatgttgatggccatgcacagtggctcagcagaactggctctgttgaccaggcttgggtgctctcctgcagggcattgcaatctttaggacaccttcattacccctcctaaaaggagattttataatgagcgccaaccagctcaaacaagttaggatctcctaacatgtctggtgaaaatacaggagtatttttcatcatctctggaaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttgrattaaaaatggtaccactctcataaatcaatgagtttcataccctaaattatgccagattaagaaaatgaaatctgactgtaaattacttctctaggagcaaatgattgcttgattctattgtagaaaataaaaattttttacytaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgaaaacagtggttggtggtttataagaagttttttgtcggtgtgatctttcacatcagtttgctacccagaatttaaacattccttttttgctgctgttttaatttgaaataagaatggtagcccccaggtcccctaacagtgggtgctgatttcacagtgggcttacaaatgctcttcaagagtatctcagtgttgagtccagccacccaagggagactggttcttcactgtgcatcatggccttttaatgccattttgcttttttatcatccaatcagcagatgttctttcttcattcacgttgaaagcacttcgctatggaaacgagtaaagttcattgtcttattttttgtttgttttgttttctgatgtcctgacagcagaatcaatcttcggaatccttttcaataaaaaaaaaaattaccaaaacaaatatgatcacagaagcttttaaaatctgaaatcccaggaagctaattagtgcatccttttaagatggcttcctgcatttcgatatacgcataagcttgggtttcagatgcagttggcagtttgccatgagtcagacaggtcatcctgactctcaggaacacggagctcctgcagaagcctgtggagcgagggcaagttgggatcctcccctgtgttagcacgtgactgtcctctgtcaccatgtagcaggtggaggccaggaactacattttcttgggttcctggtggttagttgtacgccccatgaacttctctcatttccttaattatatccaaaataatgcccttgttttatttccccacttggcactgagccttagggagcaggaactgtgtatatcccacagctttgcatggcacttggcacgtaggaatgtattaaatgcagctgctttcgtgcaggaagcgcggacttcagatttggtcaaagatccatgatttcagagcaggcagcccttttaaacctgtatctgagtcacttcaatgccttgtgtttctgctctgggctgcaaactcaagagcagcaaccacttatcttggtacctgtagtcccgagccctgtgtctggctcagagtaggccctacataaatgtttgctcctcctcactgagtggctgcatgaattgcatccagcatgtctactctgggaaagaacctgtggagcctctttaggagtgtgtttttgccctccctcggaatctggtgatctcactaccaatggcaaagacaaactgtgaggtgtttttttgtttgtgtgcacgcgcacgtatgtgtgtgtgtaaaaaggccatggaaatataaaattgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaartaagtaaataaatgcctctgtgaatccatytcattgcattggaaagacctccaggattctctscagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaacaggcagagactgggaccagaagctcactgtggttctaagcaagcagttgaactggtggcttctgatggcctgagaagcagtttcccttgataagtcttcagccacacaaaaagagactgtagctcacaacactcacagtcaaagccactggaaataactatttcctatcaaataaagcctttctcttgaaaaatttgaagaaaaaaaaaaaacccacctagtgaaaccttagaatcaacctgaaggttcaacagcaggtgaatgattccataaatcatagtatattcacttaatggaatactaggtagccactaaaataaaatgacagttggaaaaaatacttatgataaaaggtttaatgacaaagtggggttcaaaatgagagatactctctgactagaactatattaaaagaaagatggatgggggagaggacggtgggtgatatattatctacatagatactttttttcacttttcaaagtgtttaatgtgttgcacagcctttagaatttgaaaatgtctaacttaaaatgcctccctagtgaaatctgtggcagcttataaactggcaggatactgtattttcaagatacgcaattgtaagtggtgctcacatacagtcagaatgtttatttgaccttgatcttgtgagggcttggttcccatggctttgtagagtgaaaggtcctgagaggcaggttagtgacgataccgggacacgtattgtagacaggttgataaagcaagcttccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatamaaaaattagccaggcgtggtggcgcatgcctataatcccagctactctgggcctgaggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatgagtgagcagtactcatggttaattttagaagctaataagtatatatttgataactttaacagaaatattaatactaattaagagtaaaaagatgatgaataaagtagcttcacttattgagcctttactagatgccatcttgcataaatggttgtcattttgcaaaatgtattccatctaatattagcagtaaccctgaggacttggtattcttacctggatgtgtcttatatcaacatgcacgcgttctctccctcagcataccgtgtcttattaacttctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcggccacaaagctrtggctctggtcagtctgactctctttagcaggaatcacgtgacaatctgtgtctgtgattagctccgtggatattactaggtagatttctcacttgtccttgttttgatcttcattcctgggtgaaagaatcccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacayatcctgctccccactcccctaattactcatgattscactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgaggatacacacagttttctccccattagcatctscagtctctggtataaacttgagtcttctctttggtccctgataaatatacatagaatgtatggatgtgagaaagttaaactgatgtctgtgtgtcttcatgtcattaaactttgaatctayggacatgtctttttctttctggcatagtttggaggtcttcattttrtgatwgaatacaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactcagtgcacaagtccttctgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttgttcttttacaaaaagggtcagcagactttctgaaaagggacagatagtaaatattttaggctttgtggaccatagggcctgtgtcaaaagtactmawtgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgrtgacttctygctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgccyrgctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgsgatgtgcmtacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaatcagtctactgtgctaaacctggccctgcctcagcaatattctgtgagcctggaggtcaagagttaggggaccaaggtcctgctaaggacacatgggggaactaccagaaactcatcatctcatttaaactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacataaaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactawtgcagtatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttccattgtatttgagccactggaaatctattacctgatctttctttaccagatccttctttagttgggtatggccaggctcagtgaatccagtagatgtttgaatgggaaaggactgaaagatctcaaccttgaatcccttaactccttgggatgtgtaatggagatgtataagctgtttttaaacatttcagcagctgtcatggaacttaaccaaatgagtctaagtaccctatgaacacatttgatttaggttggaattacagcatagatgtgaagtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagrtcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctatccgttaacaggtttatttcttcatcagatattaattccagagggtttcacccattataaaatggacataaagcctggggtggtgatggtgctgcctctgtaaccaggctcagctgtgtgtcttcgtgagcctccttgtggaccctcaaatgtgggaaggagataggggcaggaggaattggggaaataggaaccttagaaaccctgaagaagtggaaagagaaaaggaaggtcagtcattcattcaattgcttaatttgcttctttctttttctcttcttctttctctctcttctctctctctttctccctccctccctccatttcttcattcctttcttgtctccctgtctatctgtctgtgtatatctattcatctatccatccatccatccattcatcaatccatttatccactctgaatagaaacctaatatagatatacaaaatgaaaaactaggaaaatgcaagaaaccttgacaaaattgctactgtttctaattccaatacttaataataaccactgctacatacaaggacatttgtgtctggtctttttccctattccaggcacatgcattttaatacagttgagatcatattgtatgtctgattttttagcgtattagattttttacattattaagttaatacatgctcatttaaataagtcaaacaatatgaatatataagaagaaaacgctcgtaatttatgctctacctcttccctttgctaagtggcaattttggaccttctgtgaccgtgcaaacatgcagattatacatgcactataggagtggaatgtatgtgayttaatagcgtaatattttgtccattattttaaaacttgctttatttggtcaagacatacggaacacgtatagatcaaacaaaaatttttaaaaatgcttgcatactgctctgtgctgtggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattttgtatcctgtggttttacttaacactatgcagaacgatttcctcgtattgttgaaaactcttggtaggggttttttttttaattggctggaagcacttcatcatatagttgtaccaaartttgcttaacatcccccttattactcagcctttgggtggtatccagttctttgctttgataaataatgctgagatgaacatctttctgcatggctctttttccttcttttgacatacttggagttctagaagtggaattactgggtcggaggtcacaaatggagaggtcttttaaatctcagcctgcaaacaatcccactgcaggtttaggctgcatgtttcatccatttgcagctgtagcattttacaaaccacagcataaaccctaggaataattctgttccccactgggatagagcattgttattaatataattttacaaacatcattcgtttgaaagctttatccagcctcaccacagctcattagtgaaccttctgacaatcccggggcagtttgtggattctgcagcagacaggttatcgtgtgctgaagggtaccgcaaggggaaccttccaacatccccaccctacccaaaggatgattcctgctcacaccagccagctggagacattagagcattacttctcggtggcaagggagggactcttgttctttctggtggttcgttttcatcttcaggtcatgccctgtgtcacctgactcaggcaccattagcatctggggctgtacacgtctttgtactgcacactgtagggtatccaggattcctggccctgcccsatgatataccagcgccatgttgtcatcaaaacraccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatatcagggtgtttaaaagccaagattctggagtcagaaggcctgggttcaaatcctgacccctcctcttgcaagcttgtgacaccgggcaagttattaacctctttatgcctttattttactataaatatgggataattatagtttttactgcatagttttgttatgaggagtaaatgagtcactatttctgagacacttcgtgcctggcasagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagccttgcccactgtctgtggctgaccagctagactcttttccttttcttgcaaacctaatgtaggtacaaggtcaaggctccctgtgaggcttgcatagcaccttcaaccttctagtctttgtcctcccagaaggaaaaaaatgagaggagggagggacacaagaaaagaagatgcattttgtcagccaccgtgctatgaaatgctagcgcagatgacgttcagaactgccctgtgagcagacataaaagcttaggctcaaagagattaaatgtcttatttctgcttttggaagatacacattttatttttttctgtgtctctgaattggcatccaaccataatcattgtgctaatttactgtattcttactctccctctccagtgctgtgagtaaatcagtgtgttccttatacttaataacatactaagtggcaataataattattataacaaatgtatcaaataactatgtgtgaactctgcatgtttcagcccatttaatacccattacctacggaggtggtttctactattgcacccactctacagatgagaaaatggaggcacaaaaagttaaatcatctgccctaggtcccagagctggaatttgaaccaaaggttctgtgcctcccaaatttgtattcttatctctgcatcacactaacactgtcactcagtccttttctcactgctctggtctctatacttagagcttcgagacctgccactcagatgactccagaagaaaacacgctttggtgtcgtgcttgcctttgcccttgtcactttctcaactctcctcacctctgtgactgcatctttataactctcctttattagtgcttttgctggaggaggcaagcatgaacattgtcaaaaggactcaaaatggggaaaagtggcagcaattgccagcacaatcactgaaaaatcttctgaatggattgtaaattaaaccctcccccaaatgctcagaactgttgaattgactaattcaaattcattgagtcagatgcagttagtgtaacagtctatagtaacagtgtagactattagtttgtagagtccacacagaagagtccaattttctttgcacaaagagcctaccattcatttattcaacaaatgcttttgaacacccatcactgtgacagacagtggcaatgcatgtaggaacaaagtgtgtccatgggggcagagacctggaataatcagtcaccatgtaaggaaattcaccagaccaccaatttccacgccttgtatgtttctgttgtctttgctgcagactgaccaaaagcacaagacaaactcttgtccacttggattttagcatctttccctgaccctgcctctgactctggtgttgtgcacccactctgcaactctccaagctccagccctgtagtgccagcctgtacctgcctctcctgagggtcaatatggcatccagccttggtgaagtctcccaccccgtggtgattcatatctgaccctgagaattttccacctttcccagaagagtgggagtctaggaagacaaatagccaagataggagtttgaagaggaggcaccaatggcaatttgggttgttaattcctccagctaatttagttctgatttccccatgctcttggcagtgagacagttggctccagaggaaggtgataaaaaggaatcagtcaaggaacaatcaagaacgtgttacttttttggataatcattggctgtagggattctcctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagggggagaggccccttccctctgtgaaatatagggaaaagttgtttttcttttctcctagtttcagaatacttggacttacagtcccaaatagcatcatttcctggtgaagccccctgaaccagacaggaaactgcctctcttcaataagagcagaggcagtctcaataaaaaacaaaatttcaacccatcctccgctttggtggcaggcagttcatcttctcacctctacttatttacagtttgaggggaaaaaagaggtaatacttgaaagtgtatttgaccatattttctaactgggagacaatttttttctttaacaattacttttggacatattacttgttagttaaaggagatgtgacacctcctgcccccctggccagccaagatccatttgtcatccaggtagcctcagaacggattgagagctcgccgcacagatctcatgtcaaagacaggcgcgtctgtctttcacggcttgggttgtcaggatgcagggagggccttttgtcaaacacctgccgatgagcgtttggcagagcctgtgctaagacatcatagatttccttctgtgttgtcttgagagcagagaaggtggcaggttaaagggaatcaggaaagaaatgagagtgaggataaacgagagggtgtggttctcagggtagaatgcatcggacactgcctagtgtgagaagggactcatctgttttctaggaagtactataaaaaagataaatttagtgctcagatatctgaggcctgatattaggaaaaatacggtaaggcatacatttagaacagatgccatgtctgtgtgtgtgtgtgtgtgcatgcgtgtgtgtgtgtgtgtattattaatatgtctgctggccttgagaaggtacattcagagaattttctgaagtctttttcacatggcctgtattgtcaaaaaatgatgttgggtgttttctgcctgtggctgtgggcctctgtgttcacacagatggtcatatgttcctaaaggatacatccaggactgtgctgacttatttggggtggctgagaagagacatgagccagatgataacaggaataattcagtgtgtgcttcccatggctgctgtaacaaactgcacagcctagagggcttcaaacaacaggaatattatctcacagtcctagaagccagacgtctgagaccacagtgtggacagggccatgctccttctctagagaactctccttgctcctctcgcttccggtggttcagtggcaacgcttggtgtttcctggcttgcagctgcaactatctgacctctgcgtctgtcctcccacggccttctccctgtgtgtttctggatctcttctcctttgttatcaggacastggtcacattggattaagggcctaccctattccagtctgactgcatcttaactgtttaactctgtattccaatctaattacatgtctatttccaagtaacgtcacattctgaggcaatggcggttgggacttgaacatatattcttcgggacatgattcaacctataacaagtaatactagtaatcatctcactcctgtaaacagtacagttgccatacctcaagtatctagtatacttgggacattagtctgggaatttttctccaatcctcacgctagcatttctagtaatgaggaaactgggggtcagggaagcttagtccacatttctcaccttttctccttttctcccatcccccagccagtttttcaacatattggtttttcaccacatgctcactgcagtgaatgttcactcccaagcccaaaagtagacatgtggagtgacaggtgtcactatatcataatatgaagaatttcaaaagccagaagtgcttgagaaaatataaattgtgcagtaaaagaaaacaccctaaatgtgcagagcaggaagtagaatgactctttgggtattgtgtttgttaggggggtcattagaaaatcatagacactgagccgaaccccctgggttcaaatcccagctccaccacttacgaattgaatgactttgagaaagttacttaaatgctgcgtacttcattttcctcccctgtaaaacgggttaatatcagcacttatcacatagtttttgagaaagctaaacgtgcttatctatagtggttattattactagaaagaatrtcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacascscacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcstggctaatttttgtatttttagtagagatggggtttcactatgttggccrggctggtctcgaactcctgggctcaagcaatgcactggccttggcctcccacattgctgggattacaggcgtgagccaccatgcctggccccctttcacttgtattttttgagaagagaaagaaagaattatgaatgaattcttctgagctgtgagtccttcctgtgcaccaggcatggatggcaaggcacgattgataatgttccctcttatctcgaaatgtccactctctctcccatgcacrgggagtcaagctgtgctcttcaaacacaaattccttctcccacttcctgggtagttatgctcttttcttccctgaggttgctaattgtgggcagtacagtgtagagtcactttgatttttctcatctccttcctggaatgtgccacagaagaaaacccacgaagtcttgagctaaacgaagcagagatgggagaagggacaaggtgggaggcggtagtggtgctgcatgggataaaaatggaaacacacacttttgccctctgtacccaaaaggaaatgtcggtggaggcaggcgttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcagcacgcrttgccagagaaatcacagatgactaattggaatgcctcagaatcattctccttttgtttcacctaatttccacacttacgaagtcaaactctcagttaaatgtttatctagcaattcatttcttctgagccatctgttgctaggcaggatctgcagacctcttggttgcatgtgctgggttgggtcctccaagtctcttagcacaaagtcctgatgtttaaatcctgcaagcgaattgccacctttatttccaagttctcctcgaaatccacattcttccctacagacaacggtggggttcagtgtttgcttttcctggggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaacttgtstgctagaaacctasggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacrcagttgttacctgctcccgktggragggrggggatatttatttggcatcttgcaattgataggagctgagtgattttagtaggtagtttaactccttaaaaacttccagtggtttcatattctacctagttttaggtgacagctggtatggggtggggaagsrgggggggataaagatattaatttggaagcatttgattgctccattattttatcatcttcccatggaaatgttttcataacgysttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcrtargtctctgaaaattcagacccacagaggccttaccccgctacagagaggccccargagagaggcctcacaccctctggctccactgaaattcacttcacgtttccaacttggattaaactggcacgamagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagttttattggaacacagccaggtgcatttgtttacctattgtctatggctgcttttgcactacagtagcaaagttgagtacttataaatgtagagcctgcaaagtctaaaatatttactatctgcccttttgcaggtaaatttgaggactcttgagttagacagctaattagttggtgttacctaaattttgtgaattgtggctaaatctctcatttgtctacacattcaaataaaatcatgtatcaaaggtgatgtgtgtataataagatgctgggaagatgagcaaagcatgacttcttttttttgttgtttgtttgtttttaagagacggggtctcgctctgttgcagtgtcgcccaggctggagtgcagtggcacaaccttggctcagtgcagcctccgcctctcgggttcaagcgattcttctgcctcagcttcccgagtagctgggactacaggcacctgccaccacacctggctaatttttttkgtattttagcagagacagggtttcaccgtgttgcccaggctggtctcgaactcctgagctcaggcartctgcccgcctctgcctcccaaagtgctgggatcacaggcgtgagccascgcgcccagcccatgacttctcttyatgggagagaaaggccaccgagatagtaagtggacatcaggacatggattctattaaatctaacacctttatctttgcatttccatacattttgcttatttcaaagtagctacaactgcacaaagaatgggctgtcctctcctgctactttataaaagccaagtttttgcttctagctggtcgaaggtcctgtgggagctcacgtttttctcaatyactgatgaycatttgagacataatttggagaaggtttctatcaaatcctagytggactgcagtgaaatgttttcaaactagagaagcaccaaataggccatgataaagaataaataccacctaccccaacctggcaaatgtgtgctcacccaaaagtagtggagcctcaagctcagggagatgtgactggaaaatccactgaataaatgtctatttaaaaaaatcatagcgtctaggggatatacacttctaagcccattcttcaatggagaattacttatgcgcataagtagtttaaacaaaattagtggaaaaacagggagtttmagggagcaagagatcaggtcttctgggctcaccacacatcaggtgatttaagctaaaaatggcttaaaataccgcaatcacttgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgytcctgccagctctaatagggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcatthattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacscatcccktttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcrttttactccttgtctcacattcctttctgctacttctctttggctcaccaaaaggagacagaagtttgtgtccatggctgtgaactgccaaagagttgccaattctctacgatctttgacctctgtgatcccaggggcaaggccagcactttccattccattagacttcattctcttgtgggtgctttctgctggaatctcccaatacagaacagaaagcacaggttatggaatcagatagaccaaagttcatctccaaatttgattccctctgcatacaagttgcttacccttgggggccctgtaaaatgaccataatagtaagcacctctgaggctcactggaagaactctttgttgtctgcacagaagatctcagcactaagcctggaacagaggagacttcagtcgatgtagggcatctccccaaactgcttttattctttatgcctcactgaaacttgaatcaaaaagcggctggaggaaaaagagctttgccaccgggcagtactgctgggtcttgcgtcacagagatgccttctgctcccttcttcagggagacctcagrgtatgaaagtgctgcttacccagcagatgagatttagtccagtcatccatctgcgtggtctctgtggataaagtaagcgtttcattcaacttttaaaaatattgcaaattgaccctcgcacatcttttcttactgccggtcacctagccagcaaagaccccaggtgagatcccactggtttggaggaaggagaggaaagtccccacttgggcaaaaacaatttaggatacctgaagattgcaaagcccagctcctcacaaagrgggtggcagctggggagaagctgaatcagtagacagacaagattgtggtttaacgagttcagggacaagagaaggccccagtaacctacagaagcaactagctccttgccttctgtacaacatggcctttggagtcacaggacgtgagtttggatcccagctctgccacttagtaattgtgtagatttgcacatgttgctggacctctctttgtctcagttttctgtaaactggggaaaatcttagtaaatctagctaaygtggttgttatgaagattctgtgtgtgtgtgtctgtgtgtgtgtatgtgtacaaagaaagtttagagcagcgtgtggcacgtaatgcatattatgtaagtgtagctcyaatgtgagttgttacttgtagagaacagctatgtcaaaaccacaccaaaaacgatttggaaaggaaataatttgactggtcattktgtttatccatcaactgagttggattgatatatttttcctttggccttcaaaggaaatttgagcattcattcattcatccttttagagaaatattctctaagcacctaccgtgygccaagctttgggttggatacctggaacccctctcagtgagatcacagtctaacagcacacacccaactatgaaatatagatggactgtgaagatgaagaaaggttctggttatgaactcacagaggaagtgacggctgaactttgtaaggacacaagtggtttaacaagtttcctggcccatatgagatctcggctccgacgttacaggcagcagtgtggggcctcaccttaccttttcccacttccatccttctccacccccgttcagttcccaggctccccttgtgtgaactggctcatttctcactgcctttctgttctacagcccccgctctgctgagtcaggaggtgctactttctccatctgctttccatcgtccaaaatttttgttgatgtttcttgatcactgagttaaataatttttccccgtattatacattcagtagagtttctggagagagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagagrwgaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacrtagcaagcaggatggggtggagggaggattgagctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctsttagtggggacawtaatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagatttcacaatgagagaccaagttgaaaaatgcttaaaattcacaagtctatatcattctgtcctccaggtaccccaagctggtttgggtttataccagtttgaaccgagggaccttcagctgaggaacatgtgctctgtgtgctggaagctcctggaggccccagggttatctctgctcacttaggtttgtgatgttgggcaaaaggagaaaatgctgagtctrttcggacccaacttccattaatgcctgagaaataatttaaatcgcaagatttccaatcccataagcagccctagcctctcttctcctgatactccacatacccagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcggtgtcaccctgagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggccaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctatcatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctctcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactgscaagtgcctctgtgctgataytgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctcagtggyttgtcataggtgtcaaagacaggagtccartgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctattcagctttaaagagtttgagagmgttttttcccctctgttaacaaacgasttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttraaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaamagcttgtttgtggttygtcctgaaatcctccctgctcacaaaacagccagctacttggttttctaaaagacgtaattttgcaggcagacttcrtagagccattctgtgcagaasaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataaacacccagcagtcctttagcacgggcatcaaggtggcccagytggaaaatttcagtgacatgccatcagatttgttccatgtagaaggacgacactatcagttagatgcttattttgttggcaaatttctatggcacttctgcttggcyayttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgasagygtaccmaggtcaccctgcccttcaatcctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaagagccacattcttgctggctttccarttcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgyaaacaggaaaggccacaggacagytcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttctgcaaatctggcacctggagatggcattttgaatcggacgacctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagarctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcctagtggtgtattcacagagtcagtggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtattgcttcagatattttataacggagttgttaacattatttcctttagatggctcyttcatcttttctgcattatgaactgatgccccaaaaggtggtatgaatgaaagtcatstgatggtgattaaagtgctctttaaatttttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcatagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattakacttgagccacacaaatcaatgggaaaagaaacagytgaatccagsataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacarcaatgacaacaacaaacccaagtctgccttatggcasattcttcacrtcgtaacaccttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttaattatggcttgcaaagcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtcccattgtaaatctgggtcaaatatgacatttagaaaaaggttttcatgggatctggatgaattaatgtgttatgtgtttgtgctaagtatgaatgtatggtgaggagtgtgtgtgtgtgtgtgtgtgtgcattaaatgttttaacacaacattgccaacccttcccctagcagcaccgtgggcaaagcataaagggatgatctggcagcagccccacttgggttttctacctgatggaccacaattaagagtggttggtttgtcagacagaaggttctacaaacgatttggtatcgaattacattatacatggagaagtygaggggttggatgaatttgttcttgcacgttcagaaggataccatctttttctctgtgtggaagaggcgcctgccacgacgtattgatatgtgtatttattttccaagcctgtccctgtatgaggtgtcaaaagttacaccagctttacaagcggagtttatgaactcgtttttccaggatagtcacattatactttttacagtcatgtgctttcagcccagtaccctttgctatgccaagatccagctgaaactgaaccaggtgggggaggcctgctaatgcccaggcagtcraaatgacgccatctcatcactccttytcttaaaatttttttttgtctttctycttggatttccagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggycccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgctttctggtgstggcctgtttgaaagtaaaaacctgsttggygtgtaggttccgtatctccctggagaagcaccagcaattctctttcttttactgttatagaatagcctgaggtcccctcgtcccatccagctaccaccacgrccaccactgcagccrggggctggccttctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctaygcttaataaaagaacatgcttgaatatcatcacctgaagtttgtattgtttctttaaatgtttgtttcagtttgtttttgtttttcattttttagaaaagaaatctagaggaaaaataaagcgcttctaataaagcgcttctcgtagatgccaggaaaacacgattcttgtttcttctctgagtgagtttgtgttttgtttttgtgctttgtggctgtccgtgggccaagttgtctcacgcgattagcatgccagcatattttctgttaaagaaagaaagaaaaaagaaaaatgactattgtttcatttcaccttaagatgttttgttattacttacttacagtgagttattttagtcctcaatggtctgctcccctgcaattagcaagtacttagtgattgattagcgggtatctctatgtttgagaatgggagctgtgcagaagctcttatctgcgcatcccatctcatggacaccatgctttccagcccgttccagcaagcacatgagaaagtccactctggcaagacggagaaaatgcttctgctgaaataccaggaaggtgtggaggctgggtgtcattgttccccctcctgatcatggcagcttcaggccagacaatgtcttgaacttctgtgcctctgcatctgtggtgcagagcagtcgaacaaacaaacaccattgccctccagtggcccatagccttgccacatcctcccatctggctatagtcttccttacgtaatccttattatcacaggacctttgaaactatgaatcagataatgtcacttttcagacattattgtcatttgcaaaagcagccgtcagaactccactctcagaatctacacctggaggggatcacccctcccatatgacctctgactttggccatgtgactggccttggccaatttggaaagtgctttgcactggggcttgcctttccttgttgatctttggaaccctgcaacttccatcatagggaacggctcctgggctagcctgctggatgatgagagacacgtagtcactcccagaaccggcatccagcagttacttagttagacatgtaagtgaggccatcccagactatccagccccagctgtgccaattcagaggagaagaaactgcacatttcactcacagcactgcaaaaagatagtaaaagtttattttaagccactaagtttcaggattacatgttactcagcaaaagctaactgatacagcttctcagctcactaaggttaatttttttctaccctacttctcttataatttggtctccagctacctctctaatctcaacttccagcactttatccactagaagccactctagtcttcctctgttcctcgaacatgccaagcacactcccaactcaaggggtgcatatttgctgtttcctctgctgaaatgctttccttccagaaaccagcatgcctttcttcctcactgatttttagtctctgctcacgttatccctgtcttcatggtgtcaccccattcttattccccttcccctctattttttctccacaacacttaatattattgtacacattatgtgtctattttttctgtctacccactataagaaactccatgaaatttgtctgttttcttcacaacttggccacagtaccttgaactgctcctgtcacacagcaaacttactgacttaataaataaccactgaaagaatgattctgggtgactaggctttatgttcaggaaaataatttccatcattgtgacaatgatcccgagccacacactgtgctaagcaggctacattaccactgtcgcccgggctgcagtgcaatggcatgatctcagctcactgcaacctccacctcccaggttcacgcgattctcctgcctcagcctaccaaatagctgggattacaggtacacaccaccacacctggctaatttttcatattttaagtagagacggggtttcactatgttggccaggctggtcttgaactcctgaccttgtgatctgccctcctcagcctcccaaagtgctgggattacaggtgtgagccactgtgcctggctttttttttttttttttttttttttttgagacagaatctcactctgttgcccagtctagagtgcagtggcgtgattttggctcactgcaacctccctccccggttcaagcgattctcctgccccatccttcagagtagctgggattacaggtgcccacaaccacacctggctaatctttgtattttcagtcgagatgggtttgaccatgttggccaggctggtctcgaactcctgacctcaggtgatccacccacctcagccccccaaagtgctgggattacaggtgtgagctaccatgcttggctattacatctgatttctaatatgactacagtcttgccagttcaccccttctccccattttactgatgaaaaagctgaggccaagaagtgtcaatctgctgttgtccatacagctcataaattgatagagctgcagttcacacccaggagtgtttgatttcaaggtcatgcagattgcctgcaccagtgccactgctccttccataagttgactatatccattctggtaggatgcaccatcttttttccttttaaacagagatggggtcttgctatgttgaccaggctagtctggaactcctggccttaagcaatcctcccattacaggcatgaaccactgtgcctggccatggatgcaccatcttaaaatcttaggctgatcagagaggtgactttatgggtctgactctagttatgcttcaagcatttggtggaaatgaaagtaaagccaggagaaagaagatattggcgtatcatcagccaaggtgctgtgcaaaatgtcaaagagaaccaagagaggacatgctggcctcctgcctcctggccgtgtctagggcctctatgctgacttcctcctctgtggatcctgcagggttcacatctgcaggctgacaagatgaggcctgggggagctttctaagggtagctgaggattctcccaaatcaagatttccaagtcatatagaccaaggcttcatacattcattcatttaacaaacataccaagtgctacatcctggaaattcaaggtttaaagtaaacccctccacagcctctgctataaaggaatttacatcttgggtctgtaggagtcctcacaaagcacaacgtcctactccactttatcagaagttatctaggttacttgaagatgaactgaggccccgtaacagtagcgattgccccctcatgcccatttctccctgaacccactcagtcagacactgtcagtccccatgggccattttctcttgccagacacatcaatcttatttccttggctatttctgtgataaattcttgacaggtgagcaagtgcatggcataattcctattattcctattttagcttattctatggccaaccctatttctccccatttgtcatatgtgcacatctgtatatgtatatgtcatgcacatctgtatatgtatgtcgtgcacgtgtatatgtatatatgtcgtgcacatctgtatatgtatacgtgtcatgtgcacatctatatgtgtatatgtacatgtatgcatgcacaaatatgtgtgccatacatgtaaaacacaggcattatagatgtataacacatatatgtggcacatgtgcatatgcacatatatgtattgcatatatatgtgtatattcacatatatgtatacagatgatccctaactcatgatggtttgacttatgatttttgaactttacgatgatgtaaaagtgatattcagtagaaactgtgcttagagtacccatatgactattgtttcttcctttcagtatagcattcaataaattacatgagacattcaaccctctaataaatcaggctaagtgttaaatggttgtgttaaatgcctttgtccaactctaggtaaacttaagttttctgaacacattaaaggtaggctgggctatgctatgatgttcaatacattaggtgtattaaatgcatttttgacttatattttcaacttactatgggtttagacggtaaccccatagtaagttgaggagcctctgtgtacatatatgtgtgtatttgtagtatatgatttatgtaataatgatcctactctatctgctacttttttttttttttttgagatggagtctcgctctgtcacccaggctggagtgcagcggcacgatctttgctcactgccacagccacctccggggttcaagagattctcctgcctcagcctcctgaatagctggaattacaggcacccgccaccatgcctggctaatttttgtgtttttagtagagatagggttttgccatgttggccaggctggtctcgaactcctgccctaaagtgatccaactgcctcagcctcccagagtgctgggattacaggcatgagccatcgcacccggtgtcatctgctacttctaatttcagatgctatttactgagcatactctgtgccagttgatgggttaggcaaatcactttatgctcataggatgaaagtgagttttagagagaaagtaacctctccacagtctcatagctggtagacagcagagtcaggatgtgaagccagctccatctgccttgaagcccatgggccttccactacacactacttttatgtgtggcctatagactagaagcatatatacattacattcatacaatgggtgaattatctgcaagggaagaccagttgatttcctatttaagaatgagctctggctcttctcctgataccgaaatgtccagtataaaccttacaaatcatttttgtacatgccatttatccagcaatattggcttcagccttgcctacatttctcaataggccctctctcctgttctgactgtaagttggtctgcaccttctcatggactcaacatcccgagttcttcgcgctcatctgatgctacagaatccacccaaacaggaagagtaggccagtttctctgcagtcgttttcttccaagtccctctctctccctaagtttctttcaactccaaaggtggccagtttccactttcacacctgattaagggagaccttgctgcaacttatcaataggaaacaagaaattgaagcattccccagcaatgactgaaggctgtggcttgtggttttgctttttaaaatggggttatgagtggttttgttttgaactccagtgaaggaggcctgatgacgttcatcaaggtcaacactaggccagaaagacttggcttgcaatatcactgcccattctgttcaccagcaggcaccatttttagaagcttatgtaaaaaaaaaaaaaaaaaaaaaaaaaaaaatctaaaatagcaataccctgtctattaactctttgtgtctttcaatatatccaagctagtttagctgaggtcactttagaatactaagtaatatcacaaattattattcatataatcactgaacaaacagctctgagttgtatctatagatgttatgttattgcctttcaaggattcatggtatttggcttcatgccccccctttttttcccttcccccctcaaagtcatcttatttctcaaagttttccattattttaatggctacctcatatatcacataggtgatgggccattatttggaaacccattcccctactgtgggacatttaggttatttctagtttctgttagaactaatggttcaattagcatctttatgcatacagctttttccttctattaattgatctcctcagcatacctttgtagagcgtagaactggagttccttgatccaacagctcctactggcctttgccacagagagccacaatgctatctggaagggttacacaggcagaaccagcatattactgtttgtttacaaccttatcaacacagggtgttcccactgataacattttaaactgattttcacattgtcacaacctgtaactatttatatatggtattcccaagcag

SEQ ID NO: 12480 - DNA, 112446 bp, Homo sapiens
  misc_feature (1)...(112446): n = A,T,C or G, or insertion/deletion polymorphism (see Tables 1-2)
gcactttgggaggctgaggtgggtggatcacctgaggtcaggagttcgagaccagcctgaccaacatggcgaaaccccatctcgactaaaaatacaaaaattagccaagcatggtggtgggtgtctgtaatcccaactactcaggaggctgaggcaggagaacctgggaggcacaggttgcagtgagctgagattgtgccattgtactccggcctgggcaacagagtaagactctgtctctaaataaataaataaataaataaatagtgggcaaaggacatgaacaaacactttcaaaagagatacaagtgaccaataaacatatgaagaaatgctcatcatcactaatcatcagagaaatgcaaatcaaaaccatgagataccaccttatacgagtcagagtggcttttgttaaaaagtaaaaatttaatagatgctagcaaggctgcagaggaaaggggacacttgtacactgtggtgggaatgtaaattaattcagccactgtggaaagcagtttggagatttttcaaagaactaaaagttgaactaccattcgacccagtaatcctattactgggtatatactcaaaggataaaaaatcattctaccaaaaggacacatgtacccatatattcattgcagcactattcacaatagcaaaaacatggaatcaacccttgtgcccatcaatggtggattaaagaaatgtggtacatatatcatgtaaaactatgcagccataaaaaaagaatgaaataatgtccttagcagcagcctggatgcagctggaggccattatccgaaacaaactaatgctgaaacagataaccaaacgttgcacgttctcacttagaaacaggggctaaacattgggtacacaaggacataaagaagggaacgatagacacttgggactactagagatgggagagtgggagatgagcaagtgtgggagttcagttaggctggtgggaaaattttaagatgaagttataaaatatagacacaaatcttcttggaaggccggaaggttttgcaaaagtctcaggatagggttatggctgaaagccgcctaatccttactttgagtaaatagcttaaagtagatacaaaggaatgtagagtagtttatctgaatagcttgtttactcatgtggtcttaagaccaatctttgatcaaccgggtgcacaaccgcagggggtgggggcggggttgttggcaaccaggtcaattaccctctagcagtgtttactcaaaacctttgtcatttaatctatactgaataaatgcaagcttcgctggctgatggggccggctgctactctttacagcaccttccttggtgtctgtgaggggcccagacccttagctggagtgacaggcagaatatctgtgttagtgtacgttattcaaccgttgttgggtcaaggtctgtgggacagaccccggcaagcaaggactgataaactacttactgttaggtactatgctcactacctaggttcaatcataccccaaacctcagcatcacacaatatacctttatcacaaatctgcacatgtatcctcgattctaaaatagaagttgaaaaataaaataaaattatagtctttccaaccccacttccctatccctttacctagttttattctttttcttttcccactggacatattgtctaataacatactatataatttatttatgtgttgattgtctacgtttcctcactatagtgtgagcaccacaaagggaggaaattttggggagtctattttatctactgatcattgcagtgcctagaagagtccctccacataataggtgctgataaatatttgttgaatgaataaatgagtagcatcagacatctaatactcaccttaaagtagggctgcacctaagtcatccaagacaaaaagggattttgtcatcttgttctaaaactctccaggacccggactgcacaaacatcctttgttaagccaattcctgattaccatcacaccctctccttaaatgtaatcttcagtttatttctggtaatatttaaataaagtaaatatgccaatgaccaatgactgaagaaaactatttctgtatatcctcaccaatttatccaaggttaccatgaccatattgctttcattcctttcttcttctcctacatgtggatctgtcttcattggccatcctttcactctctccaatcccccaatctgcagtctcattcactctatcaatgtgattcccaaatctatatcattgattctgcatctattcttccagcttccatcgtgtattttctaggcctactcagatgattccattagaatgccttattggtacctaaaagtgaacaggttgcaatttaaatgcctcaccttccccttgagactggcttctcctgacttcctacttccattgggcaatcaaatcctggaattctctttgactcacctccctaaatgggacccacccttgcctttgcacctaatctagtcagttgccaaatctttcattctttcttgaatctgctctcatcctctccactgctaacacctcatatcatactcctagctgggttcccaactctaaccattttagacaatcaagctaattaattttcctaaagtacaactctgattttgccaccctcttgctcaggtacctttaatagcccccccattatctacttaataaagtaccaattccataccctgggattcaagatcctttaggaatcattcctggccgggcacagtggctcacatgtgtaatcccagcattttgggaggctgaggcgggcggatggcctgagctcaggagtttgcgaccagcctgggcaacaaggtgaaaccccatctctgctaaaatacaaaaaaatcagccaggtatggcggcttgtgcctgtagtcccaactacttgggaggctgaggcaggagaattgcttgaacccaggaggtggaggtggcagtgagctgagatcacgccactgcactccagcctgggcgacaggtgagactccgtctcaaaaaaaaaagaaaaagaattgttcttaaccttctgtgtcaatcttgtgttccactacttcccaacaaaatttcagtcctaaaatcaaccccacatgttcagtcccatacatacgatgcactttgctgtttctgcgccctgactcacactttccccactactctctgctccttctatgaaagaaaaaagaaacacaccacgttaacagtaaaaattcatttccctcccaagtcccactcctattaagtttcttataattccaggaatgttctaaccattttcaggcatgccctcaaacacacatacgtttataaccatatataataaaatcattccacaagttctgcaacttgcctttttttcaattaataaaatttgtgcatgtttctgttccagcacatagattaaccgcattctttttaacagtttcatagtgttctattgaatggatatgtcataatttatgtaaaaggttccctgttgatgaacatgtaatttccagattttttattttttttagagacagcgtctcactctgtcacgcaggctggagtacagtggcgtgatcatagctcactgcagccttgacctcccacactccagcaatcctccacctcagcctcccaaagcactgggattacaggcatgagccaccatgcctggcctccagatttatttttttattttattttatttttatcttaagcagtgctggctgggcacagtggctcacagctataatcccaacagtttgggaggccgaggcgggtggatcacttgaggtcaggagttcaagaccagcctggccaacaggtgaaaccccgtctctaccaaaaatacaaaaaattagctgggcttggtggcacatgcctgtaatcccagccacttgggaggctgagataggagaatcgcttgatcctgggaggtggaggttgcagtgagctgagatggtgccatcgcactccagcctgggcgagagagcgagacttcatctcaaaagaaaaaaaaaaaagggccgggcacagtggctcacgcctgtaatctcggcactttgggaggctgaggcaggtggatgacctgaagtcaggagtttgaaaccagcttgaccaacatggtgaaaccccatctctgttaaaaatacaataaaaaataattagccgggcgtggtggcaggtgcctgtaatcccagctacttgggagcctgaggcaggagaattgcttgaacccgggagatggaggttgcagtgagccaagatcacgccattgcactacagcccgggtgacatgagagagactctgtcagaaaaaaaaaaaaaaaaagccgggtgcagtggctcacgcctgtaatcccagcactttgggaggcccaggcgggaggatcacgaggtcagcagatcaagaccagcctggctaacacagtgcaactccgtctctactaaaactacaaaaaattagccaggtgtgatggcacgtgcctgtagtcccagctactcaggaggctgaggcaggagaatcgcttgaacacgggaggcggaggttgcagtgagctgagattgcgccactgcactccagcctgggcgacagagcgagactgtctcaaaaaaaaaaaaaaaaaaaagcagtattgcagtaaacatccttgtacatttttctttgcatacttgcacagatctgtacgataaattcctcatagtggattactgggccagaactagattatgtacattttagtaactgtcaaattgtcctcctaaaggtttgtaccaattatactcttaccaatattgactttgagtgtccatttttccaaatctctttatatttttaaaaacagagatggggtcttgatagcaagacccaggttggtcttgaactcctggcctcaagcaatcctcctgcctcggcctcccaaagcgctaggattacaggcataagccattgcacccagcctgtttttccaaatcttgaccaaccaaaggctgttgaactttttcatctctgccaacttgacaatgaaaaaacatgtaattgtttcatttacttttatccatcctctctccatcttttagcctgttgggaatctacacattctttaaatcctaggttaaaaattcatcttcctcacagatcctcccccatcaaatttctcctgtctctaagcatttatagcttttcatttatacagttattacactgctttgaattttagtgactagtctgtatgttatattcctccaaccactgtagattacaaattccttggaagtaaggacctgaactcattcacagaaacactgaatgtagagctaagctaaaattctggagatcatgttaaccaagcctctcgtttttataagggaatattaagcatttgcaggatgcgttacagttcacaaaggcttttctcagacattctattagttatattaactcctccattaaattgtaagggaaacatcgttatcccattttacagataaggaaacaactccagaagatttactgagaaaagtgatttactcagaacagttccaaggtcagaatccagcatcctggcttcattcgctgttacttccacgacatctcagctgcctctggtttccctcacagcacttagcttcacaatctctagggaatgaaatgaccaaaaaaaattgtcgggtgttgacagcagcctgaacatctgtaattaaataaagcaaacatgctgacgaccaaggatgcccgggtctacacacattctttcgcctttctttctggagtcggcagacttgcccccggcagcgaccagcgtccccacccgtgcaggcggcgtctggtccagagggaaacacggctgcgcgcggcccctttaaggctgcgggcggcgcgtgcccacaggcctttcaaatggaccaataaaagtccgatgggcggtccgtcgaggaccaataaagaacgaggacactgcggggtgtgcggcggcccaagcggtttcaaacggcttagagcaggccgcttggttctgacccagctgaggtgagtggtcggtgggcctgccccacccgcgaggccctcgagtgcaggcatcgcgcgcgcagaggagcccctgaatcctgggcggctggaggtctccagacgcgcgccccacttgccccacgaacccggcaggtctgaggcggcgaagcgagccggaggccgggggacctgcggcgggcagggccgggggcgtgggcgctcgtgtgcggcggaggccggggttgggctccaggtggccagagcgcgccgcagcgtggcgcgggtggcagcgtccgcggggcgcgggcggtgcagggccgcgcctggcggcagcgatttaccaagactagggcgggggccccgagagccggccctgctagagtgcctctcgcgtaattgtcaagtgaatgaataagtaagcgcctacgagggctgtggtggttgcgaagggccttgtcgccctggagcaaggacagcggcaccggggcctggccgcacacctgtgtccctgctggcttgctgcgatgtgaacgattccgatcatccaccaccccgcccttaacgactggctttctctctctcaacgtgtcgggagcgttcwggtgtccttccagccctggaggtgttggggaaccaatacaatagccagcagtgtgggttgggccttgctactttaaggtcgggctcggtgaactagattcttacttttgagctctcccctctacttgtaatcgtggtaattgttgagcaggattgaaatgcattccgttstgtttcttggatagaaaatgatgaaagggttgttgccagagtggctagtgtgtgttagaaaatatattcgtgttgatgaatcttaacaatgagttttttattcagcatcaatagaggttgaagtggtttttgcagaacttgccccaaatttatgcgtggctctaatttaattctcatgggaccaaggcatcaaatcttggcccagaaatgctgcctgtcttatgcataattatagtaattgaaaactcatttttagaaaggtgagctcctccttcctccattttcatcaccctgaaaagtccttcttttgacctaaagagccaataaattaagctaagaatcttttgaaactttaagaaattgtagaagactttgacttctctgaagtgactggacaaactgtaatgcttttaccaaatttaatgatatagataaaggtgaaatcaatttattttgcaaccataagttaaatctagttggtaaactcatgtaaaaaaatttttaaataagattttaggctgggcgcggtggctgacgcctgtaatcccaacactttgggaggccgaggcgggcggatcacgaggtcaggagtttgagaccagtcgggccaacatggtgaaaccccgtctctctctctctctctctactaaaaatacaaaaaatggctgggcgtgatggcgggcgcctgtaatcctagctactcgggaggccgaggcaagagaatcatttgaacccgggagacagaggttgcagtgagccaagatcccgccattgcactctagcctgggtgacagagcgaccctctgtctcaaaaaaaagaaaaaaaattttttaaaaggctgttcactgaggcaatggcaagcaaaggtattccgtaacaattaacatgccttttactttattctccattactttaaagtcttgatcagttttgaattatgtttgaattatgaacagtgggtgtggtaattccatcgcagtcttctactactgacagttcagttttagcagcacctgtttttttggtgttttttgtttgtttgtttgtttgttttttaccttcacggtttattgtaaaggatgctacaaagcatacagatgaagagaggcgtagggcttgtaggtatgggagaagggtgtggagctcttatgctctcatatgaagtgtgtttgaatataccaactctcctgtaaacttttatcttaattccatcaacactcactttcttttcctttttttttttttttaagacagagtcttgctctttcgcccaggctagagtgcagtggtgcgatctcagctgactgcaacctctgcctcctgggttcaagcgattctgccacctcagcctcccaagtagctgggacttcttgtgtgcaccacaatgcccagctaattttttgtatttttagtagagacagggtttcactatgttggccaggctggtctcgaactcctgacctcaaatgatccacccgcctcagcttcccaaagtgttgggattacaggtgtgagccaccacacctggctaaccctcacttttctaactgtagcttctattaggactttatcaacaggttttgtttttgcaatactaggtaggggaagtgttccccagccagacataatatccattcctaataaaacacatttacatataggagacacagcttccaactttcatagttctgtcaacacttacatctttgtgttctctcaatttttttttttttttttttcaatcagatctcactctttcgccctggctggagtgcagtgctgctattatgggtcactgcagcctccacctccagggctcaggtgatcctcccatctcagccttccggtagctgggactacagacgtgcatcaccatgcctggcaaatttttttagtttttgtagcgatggggttttgccttgttgcccaggctggtctcgaactcctgggctcaagggatccttttgtctcggcctcccaaaatgctgggattacaggcgtgaaccactacgcctggcyttctcttaatctaactgtagccctgttcggggcttcaccaatggctcttggtactactgtacctggggcttccatatgaaggagtcccaggaatttctttttgccactccctgaccattttacctacttatatacagaaggcttggggtccccagcaggtggttgagccaagagacccttgcccatttgccagtctttatcttgactcatctacctattgtttccacaatttcagatcagatttctcattgtaatctgcctcctgacttacaatttctccaaactggggtaaatatagcaaacttgtttggaaccccttaatggtgggagaccagcagggtctccctttggctcccaggctagtcttgaactcctgggctcaagtgatcatcctgtcttggcctcccaaagtgctgggattataggcatgagccaccacaccctgctaccttacttctttttttttttttttttttttttttgagacggagtcttgctctgtcacccaggctggagtgcggtggcgcgatctcggctcactgcaagctccgcctcccaggttcacgccattctcctgcctcagcctcccaagtagctgggactacaggcgcccgctaccaagcccggctaattttctgtattttcagtagagatggggtttcaccttgttagccaggatggtctcgatctcctgacctcgtgatccgcccgcctcggcctcccaaagtgctgggattacaggcgtgagccaccgcgcccggcctaccttacttcttaataaccatttaaaaatttccaccttccgggttgaatccatttgccctctgtctcaccattctcttaacctaatggttttattagcatctgtaagacccacgagaggaaactgagacagcacatttgataaggcttctcgaactgtcttttgattttgcaacagtaaggttatccacattaaggggtcacccttaaccacagcatttaccatgactgggtagtgggcatattcagagggtaaatgtcctagtcatcataaagccagtttcacatggcttgcatatgaagtatatcagtggctctatctggatctggggtgttccacttggcatttatggaatcagactgtccccttcaggaagcttatgatactaatgtacaaagtgaaacaattccttcacattgtaccccctggtttcaatagttctttgatttttgcagaccaccttctttgttaccagaggtcttagaagcactttctgttgtcccggcatacatttttcccttgagggacagctttgaggttagtggcctaagctctcacattcactgaaagctgagcttggtctagcgggaaggtccaacccaccactttcttttaatttcattttagctgttacagataacaataaccaagggatttaacatttcgctttttttttttttttttttttgaaccaaagtcttactctttctccagggctggagtgcaatggcacgatctcggctcactgcaacctctgcctcccaggctcaagtgattctcctgcctcagcctcctgagtagctgggattacaggcgtgagccacagcacccgcctaaattttttgtatttttagtagagatggagtttcactgttagccagatggtctcaatctcctaacctcgtgatcctcctgccttggcctcccaaagtgctgggattacaggcgtgagccaccgtgccgagccagcatatcacttttttaatactagtttgcatttccttgtgcatcctgtgaaccaactcccaggcagttggatccatctctggattccatggataacttttacctttagtaattgatgacagcacagcttcagctctttaccatgggtgaccacttggccacctaagaatcaaagttctttatccctatccttttatcctttttcttcccaaaccatatgtgtctgtgagccaagtcattctagcaaatcccaattctgacgccaattctgagaatatagaataagaaactttaataagtttatcttatactctcacaatacagaaaacttctgtgacctcagatgtgtgagatttttttccccacacaccaagcaagtagttcttcagcagtggacactagctgtgtgtcctctaattcagttcaattctgacacctttttttttttttttgagacagaattgctctgttgcccaggctggagtgcggtggcgcagtcttggctgactgcaacctctgtctcccgggttcaagagattctccttcctcagcctcccgagtagctgggattacaagaacccaccacaacacccatctaattttttgtatttttagtagagacggggtttctccattttggccaggctggtcttgaactcctggcctcaagtgatccgcccgcctcagcctcccaaagtgctgggattacaggcatgagccacctcacctggccaattctgacactttctatctggaggtagtgtcagatcccacaggttgagggtttagtcccagaagactgcccccaactcagatgccaatctgaagccccaggtttttttttacctgtgcttctgtaggctgactataaaaatgggcattcctaataccgccccccattccctgccttgggtttgattaatttgctagacctgttcatagaactcaggaaaacacattttccagccagtttattataaaggatattgcaaaggatacaaagagctatatagggtgaggtataggggaagaggcatggagcttccatgccctctctgggcacaccacgctccagggaccaccatgtgttcagctctcagcttctccagcagcaaagttttaattgcaataaatttgagtaccttaatattatgaacactgttctaggtttttggtaagcaattaaaaataataaacatctttaacagtgccttaggataagtgttaaaaattttgacagggaatgagtatgttaaggtaaagccaggctctcttatgctcctttaatggggtcttattcattcattgaacagatattgagattgatgcttaatgtctgtcacacattgttctagattcagggaatacactggtgaaccagaaaaagacaaaggccctgacctaagggagtttgacagttttatctgtcaaacaatttactgtagcaaattatagtttctgtaatccctctggggtcagctctggtccttgaataaaatacatgcccagatacttttactagcagtagctaacatgtattgaatgcctactgggtcccacattttgtttaattaattaattaattaatttttttgagacaggatctcactctgtcgcccaggctggagtgtagtggtgtgatcatggctcactgtagactcaacctcctgggctcaatctgtcctcccacctcagcctcccaagtaggtgggcctacaggcacatgctaatttttgtattttttgtagagatggggttttgccatgttactcaggctggtctcaaactcctgggcttaagcaatctgccctccttaccctcccaaattgctggggttacaagcatgagccaacatgycccgctacattttatctttttttatcctcacaatgttttacagatgaggaaactgagtctttaaaaggctgtgcaacatgctcaaaatcatagaactaagtgatagaatctgaattcaaacccaagtcagtctgtctccagggcctttgctcttaacctatgattgtactacgtgaagtagggatctgtaggagaattcaggagcaatttctgggtagaattcccccagccccttttaaaaaagtacttctatcggagatgtgatgaaatatgaatgacaggcatgatagtttttagaggaaagatggcatttaccatatggaagatggacaactgtgacagtggtggcggtgggtagctaaagggacgcataaaaattgagttcttaatctaattaggattcttggtagtcaatgttggagagttttaaggtttttaaatgattttcctattcttgcctctggagtttagaatacattacttagctcatttctatcagggcagttactctacctacttgatgtgtataactccaacacattacgcttattcttttcgrtctttgcattctgttctggaacttctcacttcactctacccctacccccagcctgtattactggcactctcaggcttcaacttaaatgtcatctccttaaagagacacttttctgagctctgaattagaggagccctcttggtcacttttacttcacttttccttatttacttcatagcatatattgttatgtaattgtttattgtttgtctatatattgttagattttctcataaaaatgaaagcagaacatagattttttttttcctttgaggttacctcagtgactcaacaatgcctgcaacaaactaggtggtcaaaaatatttgttgaacaaaattggccaaaactggcatcatcttctctgaacaaaaaagtgataaaaacagtatctgactattcagttggctgtgtttctgtgtctttatttatttttttttatttttatattctaaaaatgttgcgacaatggtggctcagcaatttttttttttttttttttttttttttttgagatggggtcccactctgtctcctaggctggagtgtgttggcctgatctctgcttactgcaaccttcacctcccgggctcaagggatcctctcacctcagcctctagtggctgggactacaggcgagtgccaccacacccggctaatttttttttttttttttttttttttttgaagaggcaaggtattactatgttgcccaggatggtcttgaactcttggactcaagtgatctgcctgcctcggcctcccaaagtgctaaagtgctaggattacaggcgtgagccaccgtgtctggctgtcatttttttctttttgtggagacacagtctcagtatgttgcctaagctggtcttgaactcctggcctcaaacaatcctctcgctccagcatccaaagtgctgggattactggtgtgagccactgcaccaggcttgttcctgtgtttttgggtgtaagcagtatcttaacagtctcaattagtcttaaaattattttagactagttcagaaagtctttaagaaagctagaaaaattatacatctgaattttttaaaaaaattttaatctgttttsagaggtactagtcaaatacattgtaagatgtccttctattggaatttgtctgatgtttttctcattagactggagttacaggttttgggcaggaagaccacagaggtaaagtgccattttcatcacatcatatcaagggtacatgctatcaacatgatttatgacttaatattgaccttgactgttcatattgacctgaaatagtgtttgtgaggtttctacagtgaatttacttttttttcccctccttttctatactgtattctttgaagggaagtcactgtttgcagcccacacttaaggaatggggagttccttgatcttagggtggagtacctacctaatttatttgaaattcttgtctctcctttcccatttattagtttagtcaagtatttactgataatagtgtggactcaagtatatttattttatattttaggttacactmcaatattacattattttgttgttcaggttgttccagctttgtcctttgggagcttcctgtattcctttaacatacatgtgtgtgtgtgtgcgcgtatttgtattgatctttgagtacttccttactatctggaaatgttccaggctcatcttgtgtatttcttgtcccagtgctagaatcagccatttccccaaggtgccctggttcccttattggagaatgctattagaaacaagacctgggtactgagtgttctctttgctactggggtgtcatttcttttaggtcctttcaactgttagagcaaagaaatatatgaatgtatgctaaccccatgtatatagacatatctataaatatttctctatgtagccatctgtgtctatattaagttaaacgagttccatagatcactttcagtagtatgggcgggggggaaaaacatgagttcctactggtgtctccaattctgatccattatcacatagatcattctagcctcctccccttgctgatctttgaatttccattcacaatagtgaaaaacctaatttccaccatccatttatttaattgtccagttccattatatatggatatacatacatggatagcagtatcagaattgctaacccatactccatgaaaaaaactttatcaactagagtacatacttctgtgcagttccttttgcccttaatctttcagactccactcattaccaaagctacttaggtcagaacctttttcccaccccctttggtgaagttgtttcacacatctgtaatatagattcccttgtcatagtcttcattcttttctgcaatctcccagtctcctaaatgactttttaaaatttgcatacattaaagttcactctttatgtcataaaagtctcgaactcctgccttggcctcccaaaagtgctgggattaacagtacaacccactgtgcccagctgacataaatttttaattcagttggataaatacctagaagcaggttgctggatcatatggtaagactagttatagttttgtaagaaactgccaaactctattccagagtggctgtaccattttgcattcctattagcaatgaatgagagttcctcttgctccacgttcttaacagcacttagttctatctggtttttggattttagcccttctggtaggtatgtagtgtccccactttattattattattattttaaagagatggggtctcactgtgttgaccaggctggtctcaaactcctggcctcaagcaatcctcccatctcagcctcctgaaatgctaggattataggtttgagccactgtgcctgacctagtgttctcactttttaaaattattcgttttcacgacattaccttttttgaaaataaatgttagttttttaagaggaaactttttaaaaattaactttattttggaataattatagattgttccaacagaaaagttgcaaagatgatgtgtaggattcctgcatacctctcacccagtgtgccctgttattaacatcgtttaaacaaactccagattctgtttgtgtttcaacagtttttctattcatgtgcccattctgtttcaggatccaattcagggtaacatattgcacttcgtggtcatctctattagccttctctggtctttggcaatttctcagtccttccttgttttcatgaccatgaccattttgaggagtactagtcagttgttttgtagactgcccttctctttgtctttgtctgatatttttctcatgattagtcaagaattacgtgtttttggaaagaataccatagaataccatatcatatcaggggttttgtgatatccatgtgacatcattagtgatattaaccatgatcacttgattaagttagtgtttgctaggttaagtattaaagttagtatttttccctttctatagctattcttatgaaaatgagtagccaggtctagcccacccccaaagtgggtgaagggattagattccacttcccggagttaagggtatctacatatattcggaattttgtaaggaagatttgtctcttttcacccatttattgctttattccactgtttgtatcttatggactagtgtgtatgtgtgagtgtgtattggcttgtgtatatttattctgtactttgagattttataatctatttttttccgtcgaataattccagctttgactgttgggagctctttttggttggctcctgtgtccctttgacatgcccccatctttttaattttttttttctttttgaacactttcttattttctggtactttaatatgctccaggctcatcttttattttctctgctctaaccctagaattagacatttctccaaagatttctggttccttttgcttggtatttagaaaccgagatctggatactctgccgtctgctccttgctagtggggtgtcagtgtttctaggccttctcagccaaaacagccaggtaatatatatatgtattttaaaggataatggtggatgattattcatttatactttatttttatttttttagttgatattttattttattgacttctctcaaacagattctattcactcttctatgcacaatttcagcctgcttggttctttaaatcaattgctaaattagaaagaaggcactgctacaagataactagaagtgttagcttgatcacaaaggtcgcgaaacgaaagctgtaaaatataaagccagcctgagcaacatagacagacctcatatctagggaaaaaaaaaaaaattagctgggagtggtggtgcatgcctgtggcccagctacttgggaggcagaggtgggaggattacttgggcctgggaggtggaggcagcagtgagccatgtttgtgccactgtattccagcccagacgacagagtgagaccctgtctaaaaaagaaaagaaaaatctctatccagtacataaaaatacttttatgctttagagggctgcctacaaattttgagcaatgtttaatatgggagattcctccaaacctatggatagtccccttgaatatcaccaaatagcatataattttttaatagtgaatctgctttctataggatgaaaaggaatagattgcttgtacacccagagaagcagtttgttttagaccagagaggacttgccttacttggtcctaagggctgtaacccgacttaggcttctctttttttttttttttttttttttgagatggagttttgctcttgttgcccaggctggagtgcggtggtgcaatctcagctcactgcaaccaccacctcccaggttcaagcgtttctcctgcctcagtcttctcagtagctgggactgcaggcatgtaccaccatgcctggctaatttttgtatttttagtagagatagggtttcactatgttggccaggctggttttgaactcctgatctcaagtgatctgcccgtcttggcctcccaaagtgctgggattacaagtgtgagccaccgcaccaggccaagttagcccactcttatatcaaaggactgaaatataggtttgtttaagtctgaaatcaacctaaaatctctcaatgacactgggatgatgcttataatgatatagtaaaaggccaagccgggtggatcacctgaggttaggctttcaggaccagcctggccaacatggtgaaacaccatctctactaataatatcaaaattagctggacgtggtggcacacgcctgtaatcccagctactcaggaggctgaggcaggaaaatcacttgaacccaggaggcagaggttgcagtgagccaagattgtgccattgcactccagcctgggcaacaagagcaaaactccatctcaataatgatgatgataataataataatataataataatatagtaatgatagctgtggtttactgagtgcttggtatttgccatgaaatctgttaatactactacttacttagctgggcccagtggctcacacctgtaatcccagcagtttgggaggacgaggcgggcggatcacaaggtcaggagattaagcccatcctggctagcacggtgaaaccccatctttactaaaaatacaaaaattagccgggcatggtggcagacgcctgtagtcccagctacttgggaggctgaggcaggagaatggcgtgaaccygggaggcagagcttgcagtgagccgagatccgccagtgcactccagcctgggcgacagagccagactccgtctcaaaamaaaaaaaaaattaataataatamcaataatatagtaatgatagctgtggtttactgagtgcttggtrtttgccatgaaatctgttaatactactacttacttgcataaaatccactggatttgtttaatttgaccctttccaatcagcctttctcttatttggtcacatgggtcatatttttgttctttactcttgcctgcatcttttagagatccacacacatgcctgaaacattctctgttgtccctactttttgcctttgcttggataacccctattaatttcatttagttttcagcctgagtatcactttcacagggagaccttccctgaaccccgctgccccagtctagattagattcctccgtcatactctcttattgtactttgcctcagggctattgtggtgcacagcctatactcagcatctagatgagcatctaacaccgaatagcctcacactatctgacaagcacagttgtcaggacaggagaataatgtgaatatttgtgggaaaaaaaatttttttttttttgagataaactcttgctgtgtcacccaggccacagtgcagtggctcaatcatggcttactatagtttcaacctcctgggttcaagcagtcctcccacctcagcctcttgagtaactsagactacaggcgcatgccactacacctggctatggagggaattcttaacatgtaaaaggcaaaatctcatttawtctttacaacaatgattagatgagtcatgttaggcaagttactctgtttgcctcaattgcctcattattaaatagggataataatatcaacttcaaggttttaaggattaaatgagtaaatacatgtgaagtgcttaggatagtgcctggcacataatacgtgttcaagaagtgtgtgttaaatagggagcaacatgaagatggtattgttatgatgattgataaaactgaggatcagctggtttgtggcagagcaaggtttacaactcaatctgtctacctccagagctcaacatgactccaggtttgcactaaatttaatctagagtagagctttctacagtaagatttctttcaagcaactgttttactgccatggctttgccaaagtgaaagattctaaaaatgaaattaccctcttttagtggatcttataataaaaaagtaactaactaggaaaatagtggcaaaaatcttagaaaatttcaaaataatattactgagtgatttttttcactttgaaaagggtttacttcagaattttattaaatatatattgttttctcaacacatttgaaatacacattctacaaaattttctttataagaccaggcgcagtggttcatgcctgtaatcccagcactttgggaggctgaggcaggcagttcacttgagtccaggagttcaaaaccagcctgggcaagtggtgagaccccatctctacaaaaagtaaaaaagttgggcatggtggcaaacacctgtggtcccagccacatgagatgctgaggcagaagttttgccagagccccggaagtcgaggctgcagtgagccatgttcctgctactgcacgccagcctcagtaacaaagcaagaccctgtctcagaaaaaaaaaaaaaaaaaaaaggataagtttattgtatatttaagacttctgactgggtggggtggctcgcaagtgtaatatcaactctttgggaggctgaggcaggaggactgcttgagcctgggagttcgagaccagcctgggccacatagtgagaccctgtctctacaaaaaaatttaaaaattagacagatgtggtggtgcatgccccagtagtcctagctactcaggaggctgaggcaggaggctcacatgaggctgggaggatgagactagagtgagcagttattgcaccaccatactccagcctgggcaatggagcaataccctgtctcaaaaaacaaaaaacaaaaagacttctgtgacttgatgaaatggtgccattttagaaattttacactagagcacaaagcactatgcaatgctgggataatgaataagactcagttccttctttcaaaggagatatcatgtatacaaaaaatgttaagagagagagtgaagtgtagcctatgggatgagtataggcagatgatccaacttcaagcctctaagtgggaattttaaagttttaaagcttttaaaagcattatytatcatctaagcgggagttaaataaagaaaaagtaaatgaaaaaaatttaataatataaaaaatacaaaaacattattataaaagwtgctgaagctcattattaaaaatcagaaggcatggatgggtattaaagttcaaagtaaaagttttttcaaaaaaatttctttgcttaacccttagacacactctcagaagtcatggttaacaatttttttcttttttgagactgattctcactttgttgcccagcctggagtgcagtgacgcgatctcggctcactgcaagctccgcctcccagattcacgccattctcctgcctcagcctcccgagtagctgggactacaggcacccgccaccatgcccggctaatttttttgtatttttagtagatacatggtttcatcctgttagccaggatggtctcgatctcctgacctcgtgatccgcccccaccttggcctcccaaagtgctgggattacaggcaagagccaccaccccggcccatggttaataattttctacagatccttccagaaaatgtttatgtgcattcaaacatgtacaatgatgtcctagttttctatggctgctgtaacaaatgaccacaaacttggtggcttaaaaaaacaggatttattctctcacagtatggaggccagaaatccaaaatgagtcttatggacctacatcagggtgtcagtcagcagggccacactccctccagagcccctaggaaagaatctgttccttgcctcttccagcttctggtggctgctggcactcctaggcctgtggccatctttctctactctattctaatttttttttttttttttttttttgagacggagtcttgctctgttgcccaggctggagtgcggtggtgccatctcggctcactgcaagctctgcctcccaggttcatgccattctcttgcctcagcctcccgagtagctgggactacaggtgcctgccaccacgcccggctaattttttgtatttttagtagagacggggtttcaccgtgttagccaggatggtttcgacctcctgaccttgtgatctgcctgccttggactcccaaagttctgggattgcaggcgtgagccaccgtgcccggcctactctattctaatctttctctgatccctcttcatatcactttctccattgggtcaaatctccctccgtcttgcccataatgatatatgtgattgcctttacccacccaaacaatccagggtaatccccccatctcaagatccttaatttaatcacatctgcaaagaccctttttccaaataaagtaacatttacaagtcccagggattacaacgtgatttctttgggggtcattatcagcctacacaaatrcatatgtaaatgtgtatgtgagatacacacacacacacacacacacacacacacacacatacaaaaaaggaattagacttcatatactgtcttgcaaatttcttcttaaaacttaatggatttcttccacataggcacatttgacccttgagcaatgccaacgttagggatccccctgtgcagtgggaacttcacatataattttagacacccccaaaactttactaatagcctactgttgaccagaagccttattgataacataattgtttaacacatattttgtatatgtattatatattgtattcttacagtaaagtaagctagagaaaagaaaatgttaagaaaatcagaaggaggaaaaatattttttctcgctccatcgttcagggtggagtgttgtggtcccctcttggctcactctttctgggctcaggcaatccttctaccttagcctcccgagtagctgggactaacaggcatgtgccaccaggcccagataattttttgtatttatttttagagacagtaagtagactgtcttttaagtaaagtaagactttattgcccagtaagtagaaaatatatttactattcattaaatggaagtggatcatcataaaggtcttcatccttgtcatcctcatgtcgaataggctgaggaagaggaggggttggtcttgctgtcttaagggtgacaggggcagaagaaaattcacatgcaagtcaacccgtgcagttcaaatccatgttgttcaagggtcaactgtatttatatatttacttctgtcttccatatcatcttttgtttactttaaatatttgcaaagcaatttttgtatagacgaatgtctcattttttgtgtatggtaaaaaacaatagtataaaatttaccatcttaaccatttttaagtgtacagttcaatagtgttaagtatattcacatcgttatgaaacagatctccagaactttctcatcttgctaatctgaaactctgtatctaaatatttctcttatccccctcccaagccacacccccaccccatctttggttactaccattctactttctggttctatgaattcatgaatttgactgcatacctcataaaagtgggttcatacagtatttgactttttttgtgactgttagtagatttttttctctaatttttaaaatgtttaattcgctcataagcacagcacagggtattatccatttgtgtgtgcatacacacatacactcatygtactwtgtttattgcagttaactgaagtcctatgtcactagaatgctatgtaacagaaaatgyykstyrtacctcttgtgataaatatttgttgggtacttattttgtatcacacattggaagaaaaagataattaagatacattccagcccttgcccttgaggaactcacaatctgatgagaaaggctgatctgcaaaccattaccctcagaacagttaagcttgatgggaatataatgaatgaaggtcttaattacctaattcagaggtattctttacagttaaatgcattgtagaatgagactgtcttggcagttcaaaaatcagactgttttaatctgaatccattttttacttggcaactttatttatttatctaccccgcccccacccaagtaaggaaaagatacttggcaactttagcttagggttctctaaaaccttcagaataagagtaacctgagtctgctccctggtggagcaatcttcataactgttctttggattcttaaatttctgctttattcctgttgtggataggagaaattgggttacttacaaatggtctttaagcttactacattgattcctgtactgatctgatgatggcccaaggctttaaggaggtgtgttgattcatctaaattaggtggagtaatatggacttaaaaaaagcacatatctttcctgttggtatgatgggagacacaaaatgcagtcaaaccttgtaaactaggattcaggacaaactcctcctacaaaaagaaaattaaaactagttgctaacctttggagatctcagagactaggacttaactccttgaaatattaatgcygtttctactacaattttcttaagaactcttcatattaaattagatgattgcacattacaattgtattggcatgcaagattacttacatagacttgtacatttatttacgttgacttttaggtcaatttttgaaagatcacattttacacacaagatggggaaggttatttttctttttttcttttatagaggtatggttttggttagttgttcagggtggagtgctgtggtgcagtctggctcactgcagcctagtcctgggctcaggatcctcccacctcagcctccggagtagctgggactagtcttgtaccaccatgcccagctaattttttattttttgtagagatggggtctcactttgttgcccaggctggtatttttctatttcaccttctattaccttcctgcccatcttgtatcattgtccaggattcctccagttttgtaaagaacgaattccgtgaaaaggtgaggtggagcattgtaggatcttttccaggcctttgagttgccatttgaagaactgctcgagtccaaaggaggttaatgaagtaagcagcttacatataatgaggggctatgtatctaccttgatgctttggctgttacctgcagtaatttttttcacccttggaggagggattaggattgtgatagtgggaactggtcatctcctttgtttctggaatattacgtgtaatactaccaaaaaaagaggtccacccaactgcagtagtcttcctagttggtccatcatttgcctcttgcctgggaaagcctaggacctagaagcagcgcctgaggcctgcaaacctctgggcgaagatacactgcggcccctttaagctttcagagtgtgcggagaggggagctgagggtggggcgggcactctgacagtggcgctccgggccccgccctcggaggaggcgtttcccagcggaccgcagcaccaatgctgctgccgccgccgccgccgcctgccgggtattcctgctgatcctgctcggaccttagcttccctgacctctccctgcccggggagcgtaagtgtcaaaccacgggcaaagggcaagcatcccgcgaccgtgctgcaagtcctggtggacagtactggggactttgctggcctatcagaggctaaggcggcgaaagagcgtaaacaatgccggctccagtgagctaaagccagggtatctgctctacttctgggtggtgacagcagccgtagggtgcttgtttgggcatgcagtgggtgagcagtgcccacgacctggctttgcccccacctggttcttacttggggtgaggagagggttgcttttaccagagtataacccatttgagctgaatgggtggagctgaatctctctctctgggccttggatccttaccctggtatttgaagaccttggtagctttgggatgagtaagcattaggttttcagctaccttggtacagtcgagcagtaactccaagttgtcctaattcacagccaggtttagctgtctctccagaggcctgtgttggtggtatcccgtaccccttttggatatgttgacagtgaacatctcttaggaagagtccagttaacctttcctcctgatataaagagcacaatgtgaaagagacagctctttacccctctccatctctgaaggaatttgtgggacgccactgtcccaagattaggaaagcaaacacaccaaagtttgagataatctgctagaaaactgttcagatttctggccgcctggtaatgcagaatactccggcaagaggataacacttgtccttgttaatgggaaatacctggagacagtgagttttttttttaatttgagggaaagtgttgtcatttttgccacctgctactcagagatgggattttgtcagattttggttaagtaataaaaatcttaagttttctatgacagttacatagttgttgtgtttctttaatccagttgtccttcctagacatggtttgagtagatttctgggcatgtgtatgcattgcttttttaaaaaaataatttctttttttttttttatgagcctatcatcacactcagtggycattcaaatgggttgctttttgatggagcagaagtttttctcaaacttctgttaaaatcattctgtgcttctgcaatagcatctccttagccagaggtgagagtccaggaatggtaatcaaattcagatctcttgtattgtgatagtgaagagcttttgtaggtcaagagcttgggaatttgccataaaaaagtcatactgccagtggtttttctctaagtagaagagaaaataatctgtacagtagctctgtaattactcttatagactatcaaaatacaggaatttaaactaaaaagacaccacacttgggcccatgggttgtagggaagagagacagactgagaagtaggagacataggttctaggcccagctctagtattactcatgacttaatctctctgtcccttttaaatggttggttaatgagaaaatgcacagattttggggtctcttttatgatgggatatagtgcatatttaataggaaatttgttatttatttgaacactaaactgaaaaatcagacaatttggaatttattctaagttctgccttcatgtataaccttgaaaacatttcttaacctctagtctaaaaataaacaattatgcctaaaccttttcagcaatagcatggactatatggtatttgagctcttaggaagacatttttagatcagtggtatatgattataatatatctgtaaaacatacttactttagctgacctacttgtctttgcctcagttttagactgggataaaatctgagagctctgaataattgaaatttctgaatatgtgtctttactagggactagatcaaataaaccacagcaagcattatgtatagttcaaattaatcttcttaatgcttctctttgttggcaattttatttgctctttaggcatcaaactctactgtgtagcaaaaacttggttcttatatctgtttataaaatccagatcagtctgctcatccctatatgatacttttaactttttgagaaacttccaaatggttttacacagcagctagaccattttgcattcacagcagctggaccatttggcattcaacttaaaaaatacagaggtataataatttttattgtattttacagacatactagtattcagttggtgggggtggtagggggaagactggtcctgagtttgaaaagcacagtttgatgaacatgtgaactgtttccagcttttgactactatgaacaacattgctatgactatccctatataggtcttctggtgtaatttgcatcagtttctaggctatacacctaggaatggagttgctgggtggtagggcatgtgtatctgataatgccatactgttttccagactgttaaactattctgtctcccatcattggtgtatttgagttcctgcagattctcctgactcctttaaattacactgctgctgtttcatggcaatcctagggattttgaagaaaaatcttaatgaaagttccacatatcctaataaacttttacaattccatctttctctgggacattttcttctttgccatgggagggaacaaaatgtaaaggaagaagcatagactatgaatcttagtttaatttcattgcttaccagttttgttgttttggcaggttacttaatatttgtgaagctagtgtgtaaaatgagaatatctttccttcacatagttgatgtcagtataaagtgaattagcgtgtttaaaaagtactttgcaccatgcctgattcagaatagatattaccagagtatatattcaataaacaaatatttattgaaaacatattttatgtcaggccagaactagggatggagaattacggaggaccgcttctatgttattaataatattgaaaaatcggccagcctgggcaacatagtaagaccccatctctacaaaaaactaaaaaattagttgggcatggtgacatgtgcctgtagtcccagctccttgggaggctaaggcagaagaatcacttgaacccgggaggcggaggttgggaggatcacttgagcccaggacatcaaggttgcaatgagctgtgatcacaccactgcactccagcctgggtgacagagtgagaccctgtctcaaaaatgaaaaagaaaaattggaaacaatttaaatgtccaatggtagggttggtaattatggtacatttgtaaaatggagtgctatgtagactttaaacatcatattctcaaatctgggaaaatgtttgtgatcatataacaaaaatgttgtaaggggattatgcctgtctttttcatatgatttatattactacaygtgtattgaaaaaaaactggatacgtactttagtgttcatcatggttattaggtggtggtaaaattgtattttaatacttagatttttttctgtagttactaaattttctgcagtttacacacattacttttataagaaaaaggtgttgtctagatagatagcataggggtgggtgcggtggctcacgatcagtgggatcacttgagcccaggagttcgagaccagtctgggcaatataacgagaccttgtctctacaaaaaatttcaaaattagccgagcatggtggtgcacacctgcagtcccaccaaatcctagctactcaggaggcagaggtggaaggatcgcttgagcccaggaggcagaggttgcagcgagccaagatcgtgttcattccactccagcctggacgacagagcaagacgctgtctcaaaaaaaagaagataggtagcataaagttattaaaaggatgttgactttaaacctcacttaaaaacatggtttacataaagaatatgtataaaggttcattcagggatttaattttgtacttgtttatataaacattgactagtcatgtttgctagaattagggagcttggcagyatcaacatttttacatattgattctttccttttctttctttcttttttttttttttttttgggacggagtctgttgcccaggctggagtgcagtgcgatctcggctcactgcaagctccgcctctcgggttcacgccattctcctatctcagcctctagagtggctgggactgcaggcgccagccaccaagcccggctaattttttgtgtttttaatagagatgggatttcaccgtgttagccaggatggtctcgatcctgacctcgtgatccgcccggctcggcctcccagactgctgggattacgggcgtcagccaccacacccgacccccatattgattattttctataagtaattctaggtgaaagtatgactttttccaaaacttttttcttggccttttaaaaggccatttagctcagcaattcagttttattccagcttcgttttatatctaagaagttcttatttgggaaaataaaagcatcattttttagaaaacaaatttttggtttttttgagacagggtcttgctctgttgcccatgctggagtgtagtggcatgatcacagctcactgcaacttctgtctcttgggctcaagtagtcctcccacctcagcttcccgagtagctgggactacaggcacacacaccactacgcctggctaatttttgtgtttttagtatagatggggttccaccatgttgcccagactgcaatatatttatatttatattttttgagtgactttatttttttgagatggagtctcactctgtcgcccaggctggaatgcagtgggacaatcttggctcactgcaacctcctcctcccaggttcaagcgattctcctgtctcagacttccgagtagatgggactacaggcctgcaccaccacacccagctaatttttgtattttcaattgagacgggatttcaccatgttgaccagactggtcttgaactcctgatctcaggtgatctgcccacctcagcctcccaaagtgctgagattacaggcatgagccaccactgtgtcctgtcttttgagtgactttaaaaaaaaaattctattggccgggcgcggtggctcacgcctgtaatcccagcactttgggaggccgaggcgggtggatcacgaggtcaggatcgagactgtcctggctaacatggtgaagccctgtctctactaaaaatacaaaaaaattagccgggcgtggtggcgggtgcctgtagtcccggctactcgggaggctgaggcaggagaatggcgtcagcccaggaggtgtagcttgcagtaagcggagatcgcgccactgcactccagcctgggtgacagagcgagactccgtctcaaaaaaaaaaaaaaaaaaaaaaagtcctgttaattgaattaagtggggatctgacgaaagaacgggatttttactcttgttgttgcatgaatgataaaataataatctcagaaaagttatttttgtcttaagagactgcctggttgctaagcaggtttctacctttatctgaccaggaaatactcttaattctaaggaaaacctggaagcacaatgggagatgacagtgagtggttgaaactgccagttgatcagaaatgtgaacacaaggtaagattcttctggaattcgattttcagtgtcgttggcttgttttgtgagcagttatactatcatcttacttagaagtgtgtgaaaacattggcagtttcaaaaatactgatgccttgttagatatgttattttttctcattgaaaataggtttctgtagctcaactaaaaatttttttgtctctggaaagaattcaaagaaaagatattagtgaagtgaaaagtaagtggtatctatgaaaagtaactggctagttttttcatctccttgtatatacagtacaatatacttctggtacctaagtacttactaatattttattatatagagactcttcttttgagatgtgttctgaatttggccttagaaatccagcattttttaggttctctgatttatatgatcggcattccaatatttaccctcagaatctaccaatctttattttctagtttatgctagtaagatacaatttattacatcatgtcattatttggtgggcatcctttcagattatcttattttttccccaactatacctctagtttctttcatttttaatcattttaaacaaacatctaccatctggtagattttagaatttcatttcttcttgtaaatttattctactccaagtcctcaggtttaccactttatgttcttgacagttcttttaaartttgttttgaatctgagtattcaagatttatggttgttgattactaaaaatactgaataaaatatactaacttacacagttgtatacatacagttctacctatgtagagtagaaatttggagccatggtccctatatcctccacagaaccactccttcatcctatataataaattagccaaggccgaatactgtatcaaaaatcaacatgtagctcttcaaataaggccagattaaaagtgagctagttggtttttattctaattcgcatagaaattgttggttatgtagtacattaaattgcaacaaaaattgggggagaattttggaacttatttagaatcgttaactataatgctttttttggtagatattgtatattctcactgaaaggggcagacaatatagataaatcttagactttccgatttttgattggttaatatgtgctaagagtttttcaatctcgtgtgatttggtactttatttttcccattttttgagcatttattgtgtgtttttgaaacttaaagcatagagatgttaaatctgtttagggaacactcattctactttatagaatgagatgttgcccaattttaaaaaataaaaaaataaatctggtttaaattggttagtaaatgttcaactatgatgttaatttatgttatacttcactctaattttgcagaataggtaatgccttcttcctaatgaatgcatcttatagtgggttaggcagcattccttccttagaaggaagagttttttctgtgagcatagcacctgccccaaatcacattttcaattacattaattgaatcaattcaattacattttcaattacatttttacttacattaaacaaataacatgtaaattatttctgtttttcaatcatatgttgatccttctgtctctttgatctaatagtgttgaggacaaacatctaattctttactaatgcttaacacagtaaatgcaaattcgatcatcccacaaactaacttctcatttaactgcccccaaatcatttcattgctttcccattgctcttagaataatgagtggaatcttttctttggccttcatagtcctgcatgatctggccttttccaatcctctccagcttactttgtaccatactccccttctctttctttataggagtgggaaataccatattccctgctgccatagggccttggagtatactgttccttctggaatgttctgtctccccttttgccactctttcctgattagttcctatttatctttcagggctcagctcaattaccatttctcaggaaattttttcttaacactaagacaaagccttttataatatatactttcatagcaccaagttgcttctcctttgtagtacttaatgctttgttaattttaaatttatttgtattatagcttaatgtcccctcctgctggagtgtaagctccacaagggccagagctgaattgatttttatttattaaacacctgttgaataaattaatgaaaaaagaatacctcagtaaaaatgtccggaatctactagctgaaattaatatacagtgtaatataaagctacctaatgattatacaaaaatagaaccaaaaaacagcatatactttggagacggggcagtttcatcagggtgatttctcatgtttgagttatcacatctttaatacaatattataaagaagtaataattcttagatacaatgtgagattcatttataatggcctattatgaatggcagagtatcataaacactaaacacttgtaagaagtttattagctaatcttttttgaaaactgccaatttcttaaactcttttttcatttctagtcatggggtcctttgtttacattacctgacataggatattcatttctattctcacaccctcccccccagattaatagtagatgataatatcattaaattatgttttgtttcaaaatactacttttcttttagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaagtaagtactttctttccaactttactgataaaaacccctgtttggtgttacataatgtatgtttgtagatcactgtccttagttattagcagttttagaatagatgaattttcttactttcgtagtttcttgatacttgtttttcattcagtctttattctcagaaatctaaatggcacatgagatctgtagaggagtaaattagaaataatattttgagggtttaccttaaggtttgatgaccaagtggttttccttttaagctttttgtatgggaattattctaaactaaaaggaagagtctttagtaacttcaaaaagaaactgagagattgtcagtaaaggaattatcagaatttcactgaagacatttgggcattatagaaaactaaattttttacaagggttgttagataggtgatgttagaatcatgtctttctccctttgttcattaggcatttttatttcttgggggaggtaatgcttactaaacaacctcagtgactcctggccagtttaacttgatctgtgaatgacagatttctagtcatcctactatcccatacctcatagacctgattttcctaactctagtctctgtgtcattgaaaggaaccctccatacaaaaaaaaaagttgaaacacttgacttaattgcacaagaaatatatacttgacttacttcaaagattataccaataaagatcatcattaatttgacaatttggttaactggcatcactgggtttcctttaccgttagtaaaactatcactttttaatttctcttctgatactagaagcggttttttgataaatgctgcatgtaatctcaacccactcagttcttctgattcccggtagtgtaggtttcatttcatttagaggagattcaaagcagtaaagttattgtaaagtcttatcaaggagtcaagagtagtcttttattattaaaggtacatatccgttccctctgtgaagaaattctcttttcctaaaaagtgtttaaaacgacttaaaaaatttttttgcccagatgcagtggcatgtgcctgtagtcctagctactcagggaggctgaggcaggaagatcgcttgagcccaggagtttgaggtcacagtgagctataatcccaccactgcactccaactgggtgacagcacaagaccctgtctctctctctttttttttttttttctttttgatacacagtttcgtacttgttgccctggctggagtgcaatggcgcgatcttggctcaccacaacctccacctcccaggttcaagtgattctcctgcctcagcctcctgagtagctggaattacaggcatgcgccaccacacctgagtaattttgtatttttagtagagatgaggtttctccattttggtcaggctggtcttgaactcctgacctcaggtgatccacccgcctcagcctcccaaagtgctgggattacaggcatgagccaccatacccgaccaaccctgtctctttaaaaaaaaaaaaaaaaaaaaaattgaaagcaagcattctgtaaccctacttttgtaaagtatatttgtatgtccatatacacacacacttagagaaaggtctggaaggagggatatcaaaaagttgaaagtagttttctctgggtggtgggatttcaagggatctttaattttttgtttgaattttctacatttataaactgttactatgcctgctatgacatgtcttaaaattttatgtttaacgttaagtttttaaaatattcttgaacataaatttaaaaattaaagactcatttactgtatttctagcatttgtaaaagtactagtacaccccctttccgtgacctttttccaattcttactacttaagtgggatttttgttctttataatatgttacagaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaaggtaagactttgttttagctttgttaactagagcagcagtccccaacctttttggcaccagggaccagtttcatggaagacaatttttccatggaagaattgtgtgttggggggatggggggtcgttttgagatgaaacagttccacctcataaggagcatgcactctagatccctcacatgtgcagttcrcagtagggtttgcactcgtatgagaaccttaatgccctgctgatctggcaggaggcagagctcagggggtaattctcgcttggtagctgttcacctcctgttgtgtgcctggttcctaacaggccactgtactggccacagcccaggggttagggatccctgaactagagtatctcaattgagtttggattccgggtttaaacagaaatggaaactgcagaatttgacttggcatgccaaaacaagcaagaaagtgacctgaataaggaaagtcattccccaagtgtggcacttcatgttgactaattttagccttcaagtgtgttgtgtagttattttatctgaatccctttctyatgaagatgaatagagatttctgacctgttatcagattaagaattaggcttttcagttgggggcagtggctcatgcctgtaatcccagcactttggaaggctgagttaggaggatcacttggggccaggagtttaagaccagcctgggcaagatggcaagacccctgccactataaagaagctgaggtggggaggatctcttgagtctagaagttctaggctgcactgagctgtgattgtgccactgcaattcagcctgggtgagagagcaagaccctgtctctttaaaaaataaataaatatggccaggctcagtggctcactcctgtaatgctagcactttgggaggccaaggcaggcagatcacaaggtcaggagtttgagaccagcctggccaatgtggtgaaacgtctctaccaaaaatacgaaaaaattagctgggcatggtggcgcrtgcctgtaattccagctactcggaaggctgaggcaggagaattgcttgaacctggaaggcagaggttgcagtgacccaagatcatgccactgcactacagcctgggtgacaaagcaagactccctctcaaaaataaataaataaatacattttaaaaattggccttttggtggaaaagcactgaaaagaaaagtactggccttttgttggaaaactactcctcagggtatttaagcagctctttttctcttgctatcttaagtatagactttcgaagtctatactttgagatgttggctaaagataaagtttgtggactaaagctaacctttatttaggtgcctttttagtaaagtagaagcaaatgctatatgcctttaaagagacgcacagtgaaagcaaatagaaaagtaacttttgctcttatgtagtaagttcttttcaaccctagactttcttgtttggccatgaaatttttcatgaataggatctctttcaggaacaagtggatgtaatttgctatggaaatctgaattagacagatcactagtttgttcagacttggcagttcttctaatctgrtatcctgtccccaagtactgtctatatcagatattttagaaagcagctgtagtaaaatcctcacggaatgaagatcatccatctcacctctcatgattttgtgtatgacctacatcttggagaaaaatgtttcctttggtgtttatcttctgtgaaagtataaaaactcttgtattttgttgaatgatctttgatttataggtctttaatattgttttttgctttgctcataatgtacttttataaaatttgacttgcttagattcttacgtgaatgaagtttccttgtttctagcctattacaatatagtaagcagatgtttttctgagtagtaaacagtatgctcattctattatcttagaaatttagtgactcatcttagttatcagaactatgcttatatcaataaatcttttgtgtccttagtgatgtctaaattttaaaaaatactgtaatctttttttttttttttttttttgagacaaggtctcgctctgtcacccagactggagtgcagtggtacgatctcagctcactgcaacctccgcccctgggttcaagcgattctcatgcctccagcctcctgagtagctgggactacaggtgagcaccaccacacccagctaattttttttttctttaatagagatgggtttctccatgttggtcaggctggtctggaactcctggcatcaagtgatcccacctcggcctcccaaagtgctgggattacagacataagcaaccgcacctggcctataatcttctacctttaaattacaagtttctagtctggagtgctgtgtactctggttatttcattttttagctaaactgggagaataagggtaggaaaataacaagttacgtatatctcatgttttcttcatagatgttgttatgtagtcccatccctgtgtggttctttatttgtcctaaagcatttcagagtctatagtttaactaggtagctctctgggaccctcaagaaccttgaggccaaactgcttgatcctgggttccagagcttgctaaagctttgttagtgagagcttcaggtgaccagaaacatttgtggtacctaaaacaggtttctagtacccttttgtgttttctatagtaatacgtttagtatcaaaattaggttttattttattaaggtgtctattttccatgtggacttgctccatcttttttttcttacagaaggaggccaggatagagaaaaaagattcagatgaaacagtaataatatataggaagatttaagaaatctcaaatgttaggttcttcaggcaccatgttaaatatccctaaaacaaaatggtttattgccactataatttcttattttttgtttaatcttaaaggtcagctgagccaagttaaaatgtaatttttttaataatataaaagcattttaaaaaatcttagagattatgtaggttattctcatgatatttgtacttaaactatatcacatagccaggtatcttattaaaaattctttttttattgtgcctgtagtcccaccaactcaggaggcaggaagattacttgagcccagggggtgaggctgctgtgagctatgattgtgtcactgtactccagcctggttaacagagtgagacactatctcaaaaataataataataattaaggccaggagcagtggctcatgcctgtattgtcccagcactttgggttgggaggctgaggcaggcagattgcctgagcccaggagttcaagaccagcctgggcaacaaggagaaaccccgtctctacaaaaaatacaaaaaaaaaattagccgggcatggtggtgcccctctgtagtctcagctgcttgggggactgagtctggagaatagcttgagcagggaaggtcgaggctgcagtgagctgtgatcataccactgcattccagcctggatgacatagtgagaccctgtctccaaaaaactaaaaacaaaaaccaagaaaaaaaaatcgttggagtacactagtagctattactgagtaattttgttgcatttgctcacatgagataaatttgtgcacattagataatagataaataataatttgggtcctactactcatacagaatttcagtgttctttcataaataaatctctcctgctccagaatctgatactcacaaatgttaatagtgatattagatagctaaaattggccagttgggaacttgaaaatgtaatctatgacagatatgtaaggttaaacacacttttttttaattttattttttttttgagacggaaccttgctctgttgcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgatctatctaggtaaatgaatcactttaattataggagctattaaaggtttattaaaagtagatttcattcatgtaaatatttataaactagtttatatttgtaagcttttatatgtatatacatacatatttgtggtattaggctgggtgtggtggctcacgcctgtaatccagcactttaggaggctgaggcgggtggatcacctgaagtcaggagttccagaccagcctggccaacatagtgaaaccccatctctactaaaaatacaaaaatttgctgggcgtggtggcgcatgcctgtaaccccagctacttgggagactgagacaggagaatcacctgaactcaggaggcagaggttgcagtgagctgcaatcatgccataccactctagcctgggcaacaagagcaaaatgccatctgaaaaagaaaaaaaaagggtattaaacatgttgatcctttataggttttaattattcctagtctgcttacctagaaagtttgtttaaaaatggtaatattattttgggccctacacattaaataatattcttagaagaacaacaccttagtaggtaagcagttatgagttccttttcttttgttgccttaaaaaaaactgaacttatataattcttctaatatgtagatatggaactatgtttgaatgaagaaaagctaatgctttatttaattgcattgcacgttgacagttttttcccaattttttacttgtagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcaggtgagacaaaaagttttctggttgctttcgcacaaggttaatatgaaaatattttcttcctatcgttgttgatattctgtccttaaaaataattattttacattcttaattttgaaatcagcttttctgagcatagctaactttctcagcaattctcttgggtggcagaacttattatctgtgtgaagtacattctttctggctttttattacaattggttttggagactcttctgatgatgtaaatgtatctgaattaatgaactaatgagagtgtcttaaaaagtgggacttactgttctttcttagtgcttagacatacgtcttccttatagtaaattcaagttggtttgacttatgctgtaaaagaaataaaatttaattatatattttcttccgctggtgcagtggttcacacttataatcccagcactttggcaggcccagggagacagatcacttgagcctaggagttcgagaccagtctgggcaacatggcaaaccctatctctacaaataataaaaaaaaaattagccaagcatggtagcacagcctgtagtcctagctactcgtgaagcttaggtgggaggatcacctgaacctggggaggtggaggctgcagtgagccaaaattgtccagcctgggcaaaagagttgagaccctgtctctcaatgaatgaatgaatgaatctttcttgtttgccctggtagagccacataaataagaaattagaggccaggcacggtggcttatacctgtcatcccagcattttgggaggctgaagcaggaggatcacctgaggtcagaagttcaagaccagcctggccaacatagtgaaacctcatctctattaaaaatacaaaaattagccggatgtggtagtgcacacctgtaatcctagccactcgagaggctgaggcacgggaattgcttgaacccaagaggtggaggttgcagtgagccaagatcataccactgcacttcagcctgggtgacasagtaagactctgtctccaataaaaaaaaaagaaagaaattgggtcctgatatgtcaataaatgtaagtattaagtatgttaactaatggtggagatgcagatattatttaaatattatatgacatttgcagttgaaagaactagaagaagaatgggtcaaactgccaacaagtgctcctagacctactcgatttcttcgttcccaacaagaactagaagctaaattggaacaacaacagtctgctggtggagatgctgaaggaggtaagccaattttaaacaccggtttctgcaaaaattagcaagaactggcactgccatgagaatctgtgttcattaggcatattttgtaggattgcctttaataaaatataagttgcatgtagctttaataactctggtcccttctctattaaaatttcatcagggttgtgaaaggactgataactgataagtaaaacaattctaagcatttttaaggtttgtgttgtttttctccttaaaggtggtgatgatggtgatgaggtgccacaaatagatgcttatgagcttttagaagctgtagaaatcctttccaaacttcccaaagacttttatgacaaaattgtaagtaatagttaaacttctttcatttatttcttgtaaaataattacttgaatagaattagaatactctgctgagcccttgcctgatgcacccccttccatyccatatcttccctagtagagtgagttagttgcttcttcctctttgctcccacactactttgtacatatatatattatagcacttttttaaaacatgtcttgccataaaaccagaacattcttgacttcctttttctaattttctctctggtttttaacactaaagagctccrgattcctcccctttctccgtttctactgccactactttaccccaaggtttcttgaccttagcactgttgacattttttgtcagctgtcctgtgcattgtrtgatgtttagcagcatctttggcttttatccactagatgtcagtaataccatctccctaagtcatgacaatcaaaaatgtcttgaaacattgccggaagttccctaggagacaaaatcatccccagttgagaaacacagtcttatcccaaccaccactgtagtagtgggttgttggttatgtgattgttcttttctggtctttttaatgttgtcagtgtagaaattcctctcctgtaattgtgctgctgtgagatgggtgggctagaaatgctttctattaatgttttctgtttgacatctgcttactaacgtttgcctagaaaatgagaatgaaacgtctatggcattgtttgtttattatattactttagttataacatcttatgaaaatactttttatatatgaacaaaaatttatatatatgaacaaaatgttctgattgcctccacagttttattttttattattattactatttttttgagacggagtctcgctctgtcgcccaggctagagtgcagtggcgcgatcttggctcactgcaagctccgcctcccgggttcatgccattctcctgcctcagcctcccgagtagctgggactgcaggtgcctgccaccacgcccggctaattttttgtatttttagtagagacagggtttcaccttgtkagtcaggatggtctcgatctcctgacctcatgatctgccctcctcggcctcccaaagtgctgggattacaggcgtgagccactgcgcccggccagttttataattttttaaaaaaattatgtatctttgaattagcagagtgcaataaatagacttttattccgctctcttatttcctgttacaaatgactcatattgtatcttgcaggaggcaaaaaaatggcaagagagaaaagaggccctggagtctgtagaagtactaataaaaaaccccaaactggaagctggcgattatgcagatttagtaaaagcattaaagaaggtaaatatgaggacttgcagtactggtattgtaacagccatcaggcctttgaatttctcatcagtcatctttttaattacacatacattgccacttaaggaacattactgatggtatttgaattacagacatacatttttaaagggttgttttaaattcctgttgtgggttagtttcattttcaatctttgttttttgtcactttgactttaggtatgctatttgatagcttctgtaactctctaggaaaagagagttgctgatctagaactacattttccagttttataattctataggatgagctatttaagttagctgtatttaattggacaaatattaaacatgaagatagcaaatgataacacactactttgtatcagtatgtaaagagtatacgaatatgwggtcagttctgaaacagacaagtactaagtaagagataaacatttttaggaaataatcttttggtattgcaagttgaatgctgctggtggacattttgtatgtagtaactttttatgaaaactgtaagtatagatcaaacactgtggatatgattatagtgcttaagaacaaactctgaaaacatcttcatgaatatagcaagaatgaaaattttgttttgtttgcttcctcagtctgaaattacagaggattacaatggtgaggggaggaagttgatttttaattatacgcacacctaagtcattacttgtagtagttatattctgtaaagccactgcgaacactaaattagtgaatattgaatcattgcttcwaagagaaatacagggttaggatcctgcaaccctttggtcacaacatttccatcaatcagtacataactttgttttattctgtttggagatagcatatttaatatatgttgttgattcattaacattgaactcttggccgacaacactgtaactcttgcctgattgaagcttttcctaacgcatatattttctccctaaggtacatcacagcctgtttgcacttaggaatactagacagcatttcagcactacacttaggggccattttaaacaacaagagcaccaacaaaaaacacaaaaatgcaaaaacatggcactgaataaaccatgaaaaagacacttgtttatagtgtaaaagctaaagcaagaaggtagagtgttatcttgtctacctcagctgggaatgtgcacaatagacaacacaaaatgttcacagctctgaacttgtctgtaaatgaccaggaaagtaccatgagtgttgatttggggattataagcaagttttagcaagtaggtgaatttgcaaatatggattcgtgaatgatgaggatcaactatattctagtagttaaccttcctaggctttccttcagtgggacttggaggcagagatatgatttgtgaaatctttgttcagtcatcaattttccatcttgaagagttacactcgtgtaaaataaattaaaagagagttgccctaggggaaaaagagttttaccaacctggaacctgggaggaaagaatgggaaggggaatagtagagggcactgagacaaggaaagtcaggttccagtggcatatgaagagagctacagattctctgtcaattcttccagcatttggttattaattagaaatcttattgctctggtgctgaattctcgatgtgtcaaagaaaaccttttctttttccttatcattaatattatgtgttttctacatgtattttctaaggatattagcttctcacacaaagacagttctgtggtttccattggcattgtgaatgtaaatataatctcttgctgtactatataaagagagagcatcatggattttatatttgagtagacagacaatagatttctgagagatctagggtagcagtagaaacttctttcccttttcacgtggtggggtggagggaatcagagaccacaaacaagtaaaaagaaactgaattttgtggctaaaatatttaaaacaatgaaaagttaacttcagttgtaaaaattaacctgaaacgacattttcttttctttttgccttaagtagtgacagagacattttattttttttattttcttttttgagatggagtttcgttattgttgcccaggctggagtgcagtggcacgatctcggctcactgcaacctctgcctcccgtgttcaagtgattcttctgcctcagcctcccaaatagctgggatttataggcacttgccatcacacccagctaatttttgtgtttttagtagagacggggtttcaccatgttggccaggctagtctcgaactcctgacctcaggtgatctaccctccttggcctcccaaagtgctgggattacaggcatgagccacggtgcccagctgacattttattttttgtatttgattttagttatatgtacacacaaactttgtattatgttgacttcctagaaacataacaaaagtggggaaatggtgaaatggaaaaaagtggggaaatggtgaaatggaaaaaagaggatgagattgaagaatagattacagaccaatcctttttccctccttataattatctcttctttgtattgtataaatcaagtaatcccattaatttctcaatttttttcctttaatgaaagtagtaaaaaggcattaactttaaaatttcttatgatattcctgaaattatttttaaactgttttgagttgtcacctgatttagcatattctgtgggctttcctgttctcacagattatagttcttttttttctattatttttaattgatgtatttatttttgagacagagttgcgctttgtcacccaggctggagtgcagtggcacgatctcagctcactgcaacctccatctcccgagttcaagcgattctcctgcctcagccgcctgagtagctgggattacaggcgcgtgccaccatgcccggctaattttttttttttttaatttttagtagagacagggtttcatcatgttggtcttgaactcctgtcctcaagtgatttgcctgcctcagcctctgaaagtgctgggattacaggcgtgagccactgcgcctggcctatagttcttttatttataagatgcctccctcccagctcatcgcttctttgattttgtcatgtgcctatgcctatggacatttgattttttatatatatataatttatttatctttacattaagatttggattttcgaagtgctttcttatataatctttagacttctatgtggtattaatcttttttcacttgttctttctacttttccccccttaattattgcttgttttcatcatagttttctaaacacagtaattcataatgggtttcattaatttgtttcctttcctctgtcaacggtgtgctttagttattattaactagtggctttaatttctagttaaagataaataccaattgataattactttaaagcactttgttttaatactgtaggcctcaatttatgagaaaagtgacagcacttaaaactgtacaagatttcctattgtttaaattatattgagattatgagctaaagcttccattccctggtctagaacagaaattactgaaaagacagaagtcattgtttttcttacctctgaaatggagtcccccctcatatgttacttttcttaaaaataaacacttctccatcttccctactctcatttaccctgttgagaataacttgtttatgggaataaacaatgagtgtcaatgagtgtgacaggcaggtattatattagggtatctggtccattgctcacttataagtttatttgagcctttgcaatcttgaaatttaacagattcgcagtatcttcttcaatactatacaataagatcatgagtgtctagagtctagctcccactggttactgttccaacaatggatagggagaggtattctcctaagaaaggaatagaatgatagttttttaactgagcccatatgacaaaatcaccctttgagccatttaaaaatactgatgtccaaatttcatcccagattcattgaactagaatttgttggaatgggatcttacatgtttttgatgtccattcctagaatatatatttagatgctaaatataaagcctagcatctaaatcatatctgagaggtattttgataaggaaaaataatcagaacatttataaataccaatagtgatttcaatacagaaatgaatggaaaatttttttcttcatagacttacagtaattagagatttaacaaaatgtttattaggaccctgatctcatcctctcgtaaggaaaagtgaacttaacacaagttgagagggagaacatgctttacttaataaaaggagcaaaaactttggagtcagaattgacctgggtttgaatcacacagcattaccatttgctaactacctgactgtaagcacattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttctgagatagtgtctcgctctgtcacccaagctggagtgcagtggtatgatcttggctcactgcaacctccgcctcccaggttcaagaggattctcctacctcagcctcctgagtacctgggactacaggcgcatgccaccatgcctggctaatttttctatttttggtagagacagggtttcgctatgttgcccaggttggtcttgaactcctgggctcaagcgatcctcccacctcaacctcttaaggtcctgaggttacaagcgtgaaccaccatgcctggctgtgaatctgcaaagttgaaataataatagtccttacctcatagggtttgggtgaaaattaaacttaaaaaggattataaagtgcctacaaaattttggtgcctaatttgttttttcaataaatgttagtttctttatccttattcctcagcacttaaggagtgcatataagtgccaagtagaacttctttcatgttgcatgttaggagttgtttaatgcagagaatctagaataaagcattctgcttatggaacaccacattgtagggactagataaaattcaaagtagattggaggcattactcttactgggaaaagagtgaaaaaagaagagttgggggcatttaaaaataaagcagccgtgtgtgtgtgtgcatttataaataaagcagccgtgtgtgtgtgtgtgtgtgtgtgtatgtgtgtgtctgtctgtctgtctgtctgtcttgctctggtacccaggctggagtgcagtggtgcgatctgcactcactgcaacctctgcctcccagattcaagtgatccttttgcctcagcctcccaagtagctgggactacaggcacacgtcacactgcctgtattattatataataaagcagctttttaacaccaactgattgggcagtgtaccacagtaaaatcttaccaggaaggaacccagtcgtagtcagtatcttgttaaattgacacagatgcagctactacccgtgagtttagataagtgctgggctttgtgggttgtggcataggagggcagtaatataagcagtgctagaggagaatcgactgagactctgaattgaagcttaaccattattagatgactgaagtggcagcctcaaggccrgaagctccctcagaagaatggttctcagaagaatgcagtagcattcacaatttagagtccccatggacttcctgaaggtacctgcagccgtttgtactggtgcttcttggttatgaatattagagctgttgccctgtgatgtctttcagagatacattgccttttcattttccttgtcccaaagcaaagtcagcagacctctcgtctctctgccattatcagggtcatttcctgcacagttgaacagtgctgacagcccagactgccactactggatagtgagcaatttgatgttgtggttttatctatgttttattagtagaactttaagatagaagactaaacataatgaagggaagctcccaaattcgatacaatgaaagaagaatttctcctctgttgtagtaaataaaattggtcatatattagcataagagctttcagagttcttttttttttttgagatggagtcttgctgcgttgcccaggctggagtgcaatggtgcaattctcggctcactgcagcctccgcctcccaggttcaagtgattctcctgcctcagccttccaaatagctgggattacaggtgcctgccaccatgcctgcttaatttttgtatttttagtagagacagggtctcaccatgttggtcaggctgatctcaaactcctgacctcaggtggtccacccaccttggcctcccaaagtgctgggattacaggtgtgagccgctgcacccggcctcagagttcttttgagaataaaatttcaatacccttctacatggctgtgactattttgttttcctttttacccccctttgtaggttgttggaaaggacaccaatgtcatgttggtggctttggcagcaaaatgtcttactggcctggctgttgggctaaggaagaaatttggacaatatgcaggacatgtaagtaacactcctttttagatacagatcaacaaaatttatcaaaaatggtaggcctagtttkctgtttgctttaaaacaactccttggcatagatgtgtatatactgtacaaagtaaatttctctctgttttgttaatattcagcatagatatatcttagaaatttcagtagatgtcagttgtaacaaaatttataggccttatgtagaaaggcactaggcctaaagtacttagttgagtttatttatttgcttattacttatttacttactagtatcttgctttgttcttacaacattatacacatcataacaagatgaaacaaaacttgtaacgaccaggaccagaatgaaaatgagagtcggaaaggcaatgtaaaactataaatgtaaaactgtgaggttaatatataaaatgtgttttacattgttttcctattttaatatataatttacttacatatttgagacattttatataggttacaatgttatatattttatgtaggttatctccgttttacttattcaaagaaaatctgactggagacatttgttgacttactatttgtataagtttgtttccaatcaaatttggtaataattttaattaagatgttttctttaactgtggcatctgtcctttggcctctaaatccggtctgcattactaagaatggctcagcatcctaaaaattgaccttattgatctttagagtttagcttgctagccccttcatcatttgattccctagactgacttaggagtttcctaatagtccctagtcatgtgtccattttatattgtgaagctaatacctagcctcacatgagctatggtatttggagcttgcttactcatagcattaaaaataatctcagagaacttaactgaagaaaaagaagacactaccaaataaaaataaatcatgactggcttattactagggaaataaaaataagggtctgtaaaacccttagacatatacatcataaattgaaataaaattaaaatctatttttatagcaatcaatattatataatatcgatgtgtatatgccattttgatcaattttatattacttaggatattttacacttttatattgggaataatttttcaagataaaaaacaattttttcctacaccacttaaatatcagttcagagaataattttagttttttttttttgagacagggtctcactttgtcacccaggctggagtgcagtggcaccatctcagttcactgcagccttaacctcctaggcgcaggtgatcctcccacctcagtctcctgagtagctgggacttcaggcacaccccacaccatgcttgagtactttttgtatttttggtagagatggggttttgccaccttgcccaggctggtctcgaaatcctgagctcaagctatctgcctgcctcagcctcccaaagtgctgggattacaggcttgagccaccacacccggcctaaaattcattttaatttaccaaattatgggtggataattaactggnnnnnnnnnnnnnnnnnnnnataattaactggcttttccagtttgagttctgattctggctttgtttcagtttgttgtcctggttaaagaatgtctctattgctctgtagtttggggtctcccccaccttaatactgtaatatatgcggtgtttagtatcaagcatgttactgacttggctttattttctttaaatgtttacaaactttttggcaatatttataaaagtgaatgttagctttatagacattaaaatatcttgattttcaagtttataactagtattaaaaagtcttgtatttttccatgggaaccatagtccttgaactataccaagtagtctataaccacttctgtgaaatcttgaaaacaattatttcttgtttttggatgccattgagctttgctgtgtcctttggaccttagaaattttcttccccagcctgggcaacatggagaaaccccygtctcgacaaaaaataaaataaaaaattatatttacagggaaatggtcaagaaattaagaattaaaaaaaaaaatagcaggtgtggtgacatatacctgaggcctacctactcgggaggctgagatgagaggattacttgagcccaggaggccgaggcttcagtgagccatgttcatcccactgcactcccacgtgggtgacagagcagaggcggcaaataggttgagaagcactgccatagtgggagagaatgagaattcttcattgttccggcataagatacgatgtccttcatgaaaggaaatgactttttattccacttaaatgtttgctttattggtttgttttggtggagacaaggtggttttttagaaagtaagttttattgagataaaacttgcatactataaaatttaccctcttaaagtgattttagaatattcacaatgttacataaccatcagcactatctaattccagaacatcttcatcaccccaaaaagaaaccccttgcccattaacagtctctccccatgctgctccctgcccttgactctagcaaccactaatctacttttttgtctctggatttaacatttcatgtaaatggagtcatacaatacatggtctttgtgactgctttttttttttttttggaagacagggtcttgctgtgttgcccaggctacaatacagtgatgcagtcgtagctcactgcagctttgacctcctgggttcaagtaatcctcccacctcagcctcccaagtagctgggatcataggcacataccaccacacctggctaatttttttttgtttgttttagtagagacaagatctcactctgttgcccaggctggtcttgaactccttgcctcaagcaacccacctgcctcagcctcccaaagtgctgggattacaggcatgagtcactgtgcccagcctgtgactggctttttttttaacttagcatactatttttaaggttcagccatgttctaggatatatcaatatatcattcctctttgttgctgaataatgtgctagccattcacttttacaggttgtgccaaccatcttggagaaattcaaagagaagaaacctcaagtggtacaagccctgcaggaggcaattgatgcaatcttccttactgtaagttgacagcatgagtttgtagttttatctgaagtaaagtttgtaaatataatattttgattgttctttacaattgaaaaaagctcattaacyacattttctttctaaagaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaaggtacagactctctttgaagttgggggaatattttatacctaggcaagattcttttcctgcaaattatgtacagtgactacttgactttcagactatagaggttatgatcttttgaggagcagagcctttgcagcttggaaactgaatccaaattctcctgtgttcctcttcttgaaagaaagcacaagttagtgttatgattccattaactgttaaacatgttgtttcttacttgtcccatatactggtgttcagctgaatctggccaagcataggcatcaaatgtggagtatttgaagatcatttgggagtgagttattttagatagagggtaagaggaaaaggaaatacttatttgctaaatggattaccaagggtttccttaacccgaaaaatttttgttttttttttgttgttgttgttgtttttgttttgtttgagatggagtttagctctgttgcccaggctggagtgcagtgacacaatcttggctcactgcagcctctgcctcctaggctcaagcaattctcctgcctcagcttcctgagtagctgggattataggcatgtgccaccacgcccggctagtttttgtattttagtagagatggggtttcaccatgtttgccagactggtctcgaacttggcctcccaaagtgctgggattacaggcatgaaccactgtgcctggcccaaaaagaatttttgaaagagtaactgtcaattggcacaaggaaagctatacttagttccagtaaattgtaaaaagcaaattctttatctagcaaccatcagtctgaattaaaatgagtaatgcctaaaataccttgcattaatatcattttgcttacttctggactatagcacatcaatgattctgctcctgaagtcagagatgccgcatttgaagcattgggtactgctttgaaggtggttggcgagaaagcagtaaacccattcctagctgatgtggacaaactcaagcttgataaggtaggttagtaatggattggactgaaattggacaacattcctgtctctttgcatcatggctttgtctcttgacagttatagagtactggtagttttgatgaggagttcttgattttttttaaattgccatttatagtaggaaagaaatgcataattgaaacaagttttggaggatgctctctggtactttttgtcttcaattttgtctgttgttttattaagaaaaaaatgctgatatcacctcaggaaatttatttcatcctycactgatagttcagaccgagtttgaaaacttagcttttgagaatttaagtttcattccaggctatgatggtgataattgtagaaatagctttcaaattataaccgaaaaaaagctgagtgaccaatctgtagagaaggtgaaaacagttctgtgagataaatttatttctaaggtccagaaaattaccttcttatatgtgaatgtcttccataaacaatgtggtcattttaagtttattacaattctaatttgtaaagaaataaaatgtaagattaatatcttacgtatgtctatctactgccaaaaaagtgtagataatttatcttttttgttgaaagggaaattttttctctgaaaattttttttttttttttggcaatgaatctcactctgtcacccaggctggagtgcagtggcacaatctcagcttactgcaacctctgccttctgagttcaaatgattttcgtgcctcagcctcccaagtagctgggattacaggcgcctgccaccacgcccggctaaacttttttatttttagtagagatggggtttcaccatgttggccaggctggtctcaaacctctgacctcaagtgatccacccatctcggccttccaaagtgctaggattataggtgtgagccaccttgcctggccatttctctgaattcttatgtgtagttgtggtttagaaatgtaataacgtagtggttgtgtttcaaagttgggcttaatgatgttcatctcactttcattctccagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggttaatagattatttaaaaatagaagttagtaaggaagggtctgagtctcaggttcgtggttgttcctctaaaattattttgtttgagaaatgaattcattggccacattaaaaatacagcagaaaatctgttaatgaagataggatattccagcaataaattcagctgtttggagctttaatagagataaaaatggtgatgaaggcacagaagtgtgttttgtcaatttaacataaaatttactatcttaactttttttttttttgagatggagtctcgctctgttgcccaggctggagtgcagtgatgcaatcttggctcactgcaacctccgcctcccaggttcaagtgatcctcctgccttagccccccagtagctggaattacaggcacgtgccaccatgccaggctaatttttgtatttttagtagagatggggatttgccatgttggccaggttggtcttgaactcytgacctcaggtgatccacccgccttgacctcccaaagtgctgagattacaggcgtgagccaccgtgcctggtctgtcttaactttttaatgtgcagttcattaatattaagtatgtttataatgttgtgcagcatcaccacaatccattgccgtaatgcttttcatgttttaacactgaaactctatgaatcaattaactatcctcccattctcagcttcttccagccccttctttctgtttctatgaatttgactactttgtttttattttctatattttttagagacaaggtcttgctctgttgtccaagctggagggcagtggtgcgattatagctcactgcaacctggaactcccaggctcaagtgatcctcctcactcagcctcccaagtagctaggatgacagggacttgccaccatacccagcttatttttaaaaattttttatagagggcctcgctgtgttgcccaagctagtcttgaactcctggcctcaagtgatcctcctgccttggcctcccaaagtgctgaggttacaggcatgagccaccaagcctggccttgagcatcttttcatgtgcaggtggcaatstgtagttgtatagttctyggaaaaaaatatctactcaagttctttgcccatttttgaattgggttgttttgaggcaaggtctcactctgttccccaggctggagtgcaatggcacaatcacagcatacctcccaggctcaagcaatcctcccacctcagccttttgagtagctgggaccagaagcacgtgccaccacacacagctgattttttattttttaatatttttgtagagacgggtttcactgtgttgcccaggcaggtctcaaactcctaggctcaatgaatcctcctgcctccgcctcccaaattcctgggatcacaaacctgagccactgcccccaggcttatgatgcttttgccctctattttgttctaaagattttatagttttaggtcttacatttatgtctttattttgactttatttttatatacagtgtccaacttcattctttttgcatgtggatattcagttttcccagcaccatttgttgaatagactgtcctttccccattaaaccgccttggtacccttgtcaaaaaatcattttactgcatatgcaagggaggagtattttttttttgttttttctgaggtggagtcttgcactgtcacccaggctggagtgcagtggcacaatctcggctcactgcaacctccaccccctagttcaagcctcctcaagcgattctcagcctcctgagtagctgggtttacaggcacctgccaccatgcccagctaattttttctatttttagtagagatggggttttgccgtgttggccaagctggtctcgaactcctgacctcagttgatccgcctgcctcagcccctcaaagtgctggaattacaggcatgagccactgcgcccagccaggaggagtatattttaaaggatcagaaagtatcattaaataatgaaataaaatgtggcaacacacttaacattaataactaataataccaattggtcattttactgataatgccgatggatcacatcactgagtcttcatgccagtccaggtgtttacacctttgtacagtgtagaagtggggcaaatgcctagtggcaattacggcattcttttaatgagcatgtgtcctgtggactctcttaagagtgagagttatctgctgcagatgcaaaaagtttaactctccttccccacgccagccccatcttgaaccactcagcatggagttaggggaagagaactgatatttagtgagcatcattttatgaaacactttgcctttataatgtcatttaatcactgtaacaactcttgaggtaggtattcattatccttgtttttccaaaaaatgaaactaagactcagggagtttgtgtcctacacatgctctgatatttttattgttgatttgattgttttgtttactgtatccccacaccatattgtaagcttttaaaggatagagatcttgtcactgcttgatcctccatgcatagaatagtttctggcgtatagtagaaaccgggtatctgtttgtggaatgtgtagagtggcagagctgggatttaccctgagtacctctagttacagactctactttctttcacattatgctgtctccttggcattctagaacaggaaatcggcagctattttctcctttctcactagttcctgtttctctggacaattacctggacccaaaaccttaaaagatgtgtccagattttgcttgctgtaacccacttgcctcttacctctttaaacccttccatgttcatgctggctgaccttctcttattatgaggaattatcttaaaaattaaaatgctgggagcaacctccttctattcccattctgaaaaagataagtaggacaatatcagcagcacgtgagccactgagccagctatcatgtagaatgataattctgtcttttttgtttggttggttttgttgttgttgttgttgtttttgtttttttttgagacagagtctccttttatcccccaagctggagtgcggtggcacgatttcatctcactgcaacctctgcctccctggttcaagtgattctcctgcctcagcctcccgagtagctaggattaaaggcacctgccaccacgcctggctaatttttgtatttttagtagagatgagatttcaccatgtcgtccagcctggtctcaaactcctgacctcaaattatctgcctgcctcagactcccaaagtgctggaattacaggcatgagccaccatgcccagcctcgataaatctgtcaattaataaataaaaattgatgtctgttaacaacaacaaaaagaatagtaggagatttgttatttgaagtatctctccatatagagaatgctattacagagaaagatccagaagaggtatcctagttaatcaaagagtacagaattttccatttttagggttagaatgcaaatccttttatggggttattactgtgaaccagcaaaaccatactgtcgatatgacatggtaagtattacaggtttccatttagttaaaaactagtatccttagttttgctaaatacaacttacaatattggaatatattcaagataacattagtttcagaacaggtctggatgttgaagactaatttgatcccctttcattttatcttttctttttaggtttggggcatttcatawcaaatatccaaaataggtacaaggaacaatgtgaatggtgatgtgtgttgccataatacagttatcatttgctgtgtacattgtaatatactactttcttgtgactttttcccccgtacatattctgcttttgtatcttgggacttttgaaaactggagtggaatgaatttatttattttgagacagggtctcactctgccacccaagccagagtatagtgacatgatcatggctcactgcagactcaacttcctgggctcaagcagccctcccacctcagcctcccaagtagctgagactataggcatacaccaacacacctggctaatttttttgtattttttgtagagatggggttttgccatactgcccaggctggtctcaaactgctgggctcaagggatccttagcctcccagagtgctgggattacaggtgtgaactactgtgctcagctacttgggaagctgagatgggagggctgcttgagatgggaggctcgcttaagcccaggaggtcaaggctatagtgagccgtgatcaggccactgcactccagtctggatgacagagcaagaccctgtctcagaaaacaaacaaaaaaaaaaacccaaataaatgtaaaaaaaataaaggtatcaggatgtcattctcaaattaatttgtaaatgtagtataatttcaggccatcacttctgtttcatttatctcattaattctaaattcaagtttttaatatggggtctacagattaccccatgggtggtcttcagggcttctgtctgaccttgaaactgctaaattttgtaggtacaaaaaatgtttattttagggtaatccctcattttaatcaaatttttaagggagtgtgtgactcaataaaagtttaaaaaccactgttttaggccgggttcagtgatacatgcttgtaatcccagcactttgggaggccaagacaggaggatctcttgcagccaggaattcgagaccagcctgggcaacatggcaaaatcctgtctctacaaaaaaaattttttttaattagccaggcatggtagcacacgcctgtggtcccagctacacagtaggctgaggtgggaaggaagatcccttgagcccaggaggttgaacctgtagcaagctgagcttgtgcagctgcattccaggctcgacaacagtatgagacactgtctcaaaaaaaataaaaataaaaaactccactattttaaatccttaggtggtttaatttttattttttaaattgtttttaggctggtgggccaccaaaaaaggggaaaccagctgcaccaggaggcgcagggaatactggaaccaagaacaagaaaggactggagactaaagaaatagtggagcctgagctctcggtcagtattaacacactgagcctgaaaatcatgaaccctgcaaagtgagaccaatgagaagactggagttctttgctgggttctacaacgtacagttaattgatattttttagcttattgaaactgccttggacaatctcctttatcaaagtataatagaagcctcagaaactatagcatacctatgggagtattcttttagttttggctggagtatgtttacgttcttgtcatctgttcccttaagcaattcctaattctaatatgtttttgtatcttacagatagaagtatgtgaagaaaaagcttcagctgttcttccccctacctgtatacagcttcttgacagcagtaactggaaagaaaggctggcttgtatggaagagttccagaaggtagtgcatagggaagaattgagtgtgaaagaaaattagattatatggaagcagcgaaattgatgaatgaaggatttgtcctaattgctgtgttttataaccggtgaacacgttttatggcattaaagatgaggtgggactttttatttcttgtagctgtgtagtgtttgctatctttaaacatcagtattctatggcctttataagctcatgacttaatacttaagaaaattagattcttattctgaattataaggcttagattatttttttattttttgagacggaatcttgctctgttgcccaggctggagtacagtggggcgatcttggctcactgcaagctccacctgctgggttcacgccattctcctgcctcagcctcctaagtagctgggactacaggcgcccaccaccacacccggctaattttttggatttttagtagagatggggtttcaccatgttagccaggatggtcttgatctcctgacctcgtgatccgcccgcctcagcctcccaaagtgctgggattacaggcatgagccactgtgcccagcccagcccagcttagattaattttttaactatggtacttgctcataaacttcctaggcaaataggtcactctacttaaaccacccctcatccagtactttttctcccctttatcatcatgattccttggtagaatggacattatccattgktatgaaaacctctcaaaaacctgtgttgtaaaggagcatggcagttcattttggcatataccgggtgattctaatgaggaacggtaaggagaaacactgcaagagcactgtcacttatggcagaagccgtctrgtcctgcgtctgctgcccattgggtttagatctgagtttgtgcatctttgatattcggtactttagaacttcaaatctattctgctttgctgtttttaggaaaatcaaggaagagaaaatacatataagcagtttctgccacacactaggcaaatgaaaactattattttgcatggagcaaactatttgtgaattcctgaaatgtgagataaacgttcagtgatactaatttaacagccatataccaagcatctagcttaagaaataaagcattatagacataaaaacacaaagaaataaagcataacagcggaagctatataagctccctcaataaccctcctcagttctattccactcctttcttcagaggtaaccacttacttgactttggtatttactcttcctttggaagtaacctttaacccttaaactcttattctcttattttacttcaaggctgttgagctaatggaccgaactgaaatgccatgccaggcattagtgaggatgctagccaagaaacctggatggaaagaaactaattttcaggtattttaaaatgtgagatttgatgtcttttattgaagtaatttacattacatcatcctatggagtaatacagcagaatagttttcgtaatgatttttttttttttgagacggagtttcgctcttgttgcccaggctggagtgcaatggcacgaccttggctcaccacaacctccacctcctgggttcaagcaattctcctgcctcagcctcccgagtagctgggattacaggcacccgctaccatgcccggctaattttgtatttttagtagagacgcggtttctctatgttggtcaggctggtctcgaactcctgacctcaggtgatccgcctgccttggcctcccaaaatgctgggattacgggcgtgagccaccgcgcccagcttggtaatgatttttaatgaacaatggggtgtgtgcattttgattgaacacataactacagttgactcttgaacaatgtggtgattaggggtactaccccttgtgcagttgaaacttcacatataactctggactccccaagaacttaactactaatagcctactgttgccagaagccctactgataacatagtcagttaacatattttgaatggtacatgtattgtatattgtattcttacaataaagtaagctagagagaaaatgtgattaagaaaatcctaaggaagagaaaacatatttactatttattaagtggcagtggatcatcataaaggtcttcaattcccatcatcttcatgttgaataggctgaaggaggagaaagagtaagaaaaggggtttgtcttgctgtttcaggagtggcagaggcagaagaaaattcatgcataagtggatcttcgcagttcaaacccatgttgttcaagggtcaactgtataactttatataattaggaatttatatgtgtataaatatgtaaatatgtatacatccatatataatttgtataatttagatatatacatttttttcttctcatttttaggcctagaagcctccttatccaatctttacatattcaagggagaaataaacagtgagatagcttttttatttgataggataaaaaataagtgcagtccttaaattgccagtgaaaatttaccacataatcaattgtatagccccattaactgataatagagctgaaatttagcagtaccaagttattagtctaaggggtgggtatagagggaagtataggaaagtgctgcaggaaggaaaatgagaaaaagtttccttctctttttctagatgtacatacaatagacctcatgctaaacaaacttgaaatgtatcaggtttattattggcatcctgctagtctctttttggtttctcttctgctgccacctcttgttttctgtctaggatgtttagctccctcatacactgtgtgtcccttacattgtgttacatagcaccttattcgtataggccagctccacaaaggctaaatattctaaaagattcttgaggtgccctcttcctctcacaccaccttctttttttttgagaaagggcttcactcagttgtccaggctggagtgtggtggtgcaaacgtggctcactgcagtgttgacaccttaggctccagagatcctcccacttcagcctcccaagtagtcgggaccacaggcgtgcatcactacaccttgctaatttttttctcaaattcatagacagtatgaagtgtaatctcattgtgattttgattttcagccaccaaagactctctccttggttaacttaatgaccagctaatgactggagagattttcttaaatgccttgaaccaatgtgatctgtctcccaccctctgccaagggggaaggtgtgtatgtttgtgtgtgtgtgcgcgctgggtcatgccagagatactcaggcactttacagctttaccctggaattcactttttaagcaaggtcttgaaggtcagtcagagattagggcccttttcagtctttcctgggcatacacataaccttgaatattcgcatgaccttctagattctcaaagtcctctgtggatatcttattccctaggtccttttatgtttttgaccaagctgggttcccccagctggtattatggacttacacagttctgatgttagatgttaaacagttgccactcattgttttcgttgttttcaacaaaatccctggggatagggcttttcccactgagctagycagagtccagtcaaataacaggactttcaaatggagcttttctaggaagctgccagacaagacagtactttgggtcaaaactttttgaggaggtccaaacctgagctgtccccccacctgccagtggctgcacagctctaggttttcatagttgccatggttacaagacttcaggttttgaaggctactgtggagctggaagaaaaggggagcaaggcaagttaaatcaccagaaacctcactgtccttactaaaattcagcatcctttctttaaatggttcttgtatgttacaagccttatttaattttcagagttgtgagataagttgatttggatagtttttgccagtgttctttgttgcttttgaggaagatcagtttttcagaggtattgactccacaattgcagaagtcccacccaagataattacatttctttggtttgttttttggtttgggaattttttttttaattttttaaatttttattttttcacatgcctgctatgtcaaattttgggggtttgagacaaagtctcactctcttgcccaggctagatagtgcagtggtgtcaacatgtctctctgcagcttcagcctcctgggttcaagtgatcctcccacctcagcctcccaagtagctgrgactacaggcgagggccaccatacccaactaatttttgtacttgttgtagagctggggtccctccatattgaccaggctggtcttgaactcctgggctcaagcattcccctcgcctcaacctaccaaagtgctgggattacaggcatgagccaggcgataattgcattttnnnnnnnnnnnnnnnnnnnncacttggagaggctgaggtgagatcccacttgagatccacttgaggtcaggagatcgagaccagcccggccaacatggtgaaacctcatctctactaaaaatacaaaaatgagccaagcgtggtggcgggcgcctgtaagtaatcccagctacttgggaggctgaggcatgagaatcgcttgaacccaggaggcagaggttgcagtaagctgatatctcaccactgcactccagcctgggtgacagaacaagattctgtcaaataaatacataaataaatgggagtatttgtcacctaaattaatctgtataataggatttctagtggcgtaacaaaaaaagttaaaatattcacacagtacaaagaaaaatatttatgagcaaaggggtccttaatcccataggtctgccatcacaataatatctttaaattattttccacagatctttttattcttatacttaaaagccaacaagttctctaaaatctctgaagttctgtgttgcatgtgtgtataagagggttgtagtgtttttgtaggcagccctagtagtaattctcagttatgcagtcagtatagtaatttattgtgtattttaggrtgtgtattcagtactaaatgcaaataatcataagaggaggaaaatttaaaaatcagatttttcaattaataaactttctgtgcaatattacttgttagtattttggaacactgagtagctttttttccctctcttcactgtcagttaagtaattggtaacaattaaaggatacaaattattttgcatatttgtttaaaatcctgattttactttagatgtgtttccagctgtccctaaccatgtcatatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatggtgaaatcccgtctctaccaaaaatacaaaaattagccaggcgtggtggtgcacacctgtaatgccagctactagggaggctgaggcaggagaatcacttgaacctgggagacagacgtggcagtgagccgagatcacgccactgtactccagcctgggcaacagagtgagactgtctcaaaacaaataaacaaaaaattctatagaaggtgaaagcccacgagcttgaggctgcaatgattgatgattgtgccactgtactcctgggtgacagagcaagaccctgtctctaaaaaaaaaaaaaaacattataatgcagagtaattgctgcaaagctataaatagtccagaatgcctttagtcctactatcatttcacctcattttcttgtgtaggttcactcttgttcctaaggcattcttgcagttgttttagcgtcagaaaactagtttaatgcacatctgccttaatgtcatgctgtatttctataagaaatacgagataaaacacagatctgctgtttttcccttttcaggttgtgtcaatggctttctcacaaaagaatcccaaaaatcagtcagaaactctgaattggctatcaaatgccataaaagaatttggtttttctgggtaagtcagaacgaaatcaagtggaaaatagttaaatgttctgtcagtctctaagtcgtgctrtttataataatagctattgctgtttatttctgaagagtgagagctggattgtctcatttatataaaagaaaattacctttgttgctcaaaggtctatattggcttgtgttcctgctttttgatgttcactgaaagagttctctacgttatttttccttaagcattaatagctgtcccasagaaaatccagttccaagaatttctagtcaaatacattaggaaatttctgtatataattacatttgtttaaagacctatagtatgccttggcgaattaactgctgtcagaaatcctgcaatagaagagcttgtttaactttgtttaacccactgttcccaaacttatttgcttatagagcacggttgtttatttaaaacaaaactttatacagtttactttatcccaggtacttttaaaaagcactttctaaatcataattcatttgatttaatcatcataacaactaagcgaggtattatattatccctatcttatagatgaggactaaggcacagaaagtttaagtaatttgggcccatcatagttaggaaagtggcaaaaccaagattttaatccaggcattctggtttggagaaagaatgatgtagctgctatactatgttacctttctctgtgccatgctacattttgcaacatgcctgttaatatcttgtaaaagggtattttgagttctactgattgaaaaaacactactctagaagttactcaaataacaaagaacggtttgttatgttattatctgtggtgttcgcccatagttgagggtattgttataattcctcttaattgtatagtctttgatataacacacatctcttggcatgtcacttataaaagccatatattttcctcttttttgttatgatctttcatttattcatttattaaacaattacatattggccactacaatgttccaattgtttgttccagtccttcagaatacatcatgaaygaaattaaatttctgtttcatgggagttacatttgagtaaagaaagataggtaataaacagttaaaaatatatatakagagagagagagacagagacagagaggcaggcaggccgggcgcggtggctcatgcttgtaatcccagaactttgggaggctgaggtgtgcagattacctgaggtcaggagttcgagaccagcctgaccaacatggagaaaccctgcttctactaaaaatacaaaattagctgggtgtggtggtgtacgcctgtaatcccagctactcaggaggctgaggcaggagaatcacttgcacccaggaggcagaggttgcagtgagccaagatcatgccattgctctccagcctcggcaacaagaacaaaactccatctcaaaaaatatatatctatttttttttacatatatatgtttatgtaaagcaggatgaagggttaaatggaataatgtggtatagtttagatggtgttgttttctatatagtagttgaagagttcttcctgaaaaaatgacatttgagtagagaccaggacatgagagagcaagctgtgataatcagagaggagcattctagaccaagggaagagcaaatgccaaaagctctgtggtaggagtacatgtgatgtatttaaaatagcaaggagtgtcttttcttcagaatgtagctgtaggacaatgagtgagtgggtaggaagtggtaggagataaagctagagaaagaataggggctaggtcatgtggggcctcaacattttgaataagttgggaaggcattaggggcttttgaggagaagagtaacaggttcatattctgactgttgtcagagaagacagagaggagatcaaagacaggaagacgaattagtaggctattggaataatcctgtcgagaaattctggtggcttggacatagattgtagaagtggaagtgttataactgataagatatttaaaaagtagaatagaacaagagagagacaagtcagggataacttcaaaaagtcaaggatagcctgaataactggaagaacaatgtggctctttactgaggtgtagaagactctgggaggaacaggttttgggactggagtgaggacaatcaggagtttggtttcagtatattagatgtaggctgtcttccaggcatacaaatggaaatatcacaaaggcagctggatgatgtgaatctggagttcaggagagagttcaagattggatttaggagttgtaattaagcataataggattgtcagcctatagatagtatttaaagctcactttaaagttagtgtaggaggctgggtgtggtagctcatgcctgtaatcccagcactttgggaggctgaggcaggcagatcacttgaggtaaggagtgcgagaccagcctggccaacatggtgaaaccctgtctctactaaaaacaaacaaacaaaaaaaattagctgggcatggtgttacacacctgtaatctcagctactcaggaggctgaggcatgagaatcgcttgaaccagagaggcagaggttgcagtgagctatcatgtactgtactgtagcctaggtgacagagcaagactctgtctcaaataaataaaataaaataaagttagtgtaggaagagaaaaagtgagaactttgccaaagggagccagtcctagagtctggctttataaaactttattgagtattttgagggtttcatttgtttgcttttaattctaaatgtttcttctaggttgaatgtcaaagctttcattagcaatgtgaagacagctcttgctgcaacaaacccagtgagtacataacaacatatatagggcagtattgccatctttgtggatttaaaaagttattattgccatctttgtgatttaaaaagttatttttcttctgtctggcaggctgtgaggactgctgccataaccctgcttggcgtgatgtatctgtatgttggtccctctttgcgaatgttctttgaggatgagaagcctgccctcctatcccagatagatgcagaatttgagaaggtagaatttccacaaatgatacaatctgttagtggacttgagaatctcattaagactaaactgttgggtgtagtggtgcacgcctgtagtcccagctactcaggagcctgaggaaggaggattgcttaagtgcagatgttttgggctgtagtgtgctatgccagttgggtgtccacactaagttcagcattagtattgtgacctcccaggagctgagaccaccagttgcccaaggagaggtgaactggcccagatcagaaacagagcaggtcggccaggtgcagtggttcatgcctgtaattccagcactttgggaggccaaggcaggaggaccccctgagcccaggagtttaagaccagcctgggcaacaaaatgagaccttctctacaaaaaaataatcaaaaaattagccaggcatagtggcacatgcctgtggtcccagctacacaggaggccaaggtgggaggatcacctgagcctaggaggttgaggctccagtgagccatgtttgtaccactgtactcaagcctaggccacacagagagaccttttctcaaaagaaaaaaaaagaaagaaagaaacagagcaggtcaaaactccagtgcagatcagtagtgggatcacaactatgaatagccactgcactccagcctgggcaacatactgagactctgtctttctggaatgaagaatatgtatgtatttgcttttatgcacaataaagtatccatggaagagttcataagaaattgatgattttggccgggcttggtggctcacgcctgtaatcccatcactttgggaggccaaggcgggcagatcacttgaggtcaggagtttgagaccagcctggccaacatggcaaaactccatctctactaaaaatacaaaagtcagccgagtgtggtagcacgccctggaatcccagctacttaggaggctgaggcataagaatcacttcaacccgggaggcataggttgcagtgaaccaagatcatgccactgcactccagcctgggtgacagagcaagattctgtctcaaaaagaaaaaaaaaaatttttatgttttgtttgttttgtttttgggttgttttgtttgtttgtttgttttgaggtggagttnnnnnnnnnnnnnnnnnnnnnnnnnnnnnnnnnnnnnnnnntggagtacaatggcgcttcctgggcttattccaacctccaccttccaggttcaagcaattctcctgcctcagcctcctcagctgggaagctgggattacacgcacgtgccaccatgccaggctaatttttgtatttttagtatagacgaggtttcaccgtatcagccaggctggtcttgaactcctgacctcagatgatccacccgccttggcctcccaaagtactgggattataagtgtgagccaccacaccctgccttctagtaggttttgtataaaaataccttttgacatatggtctcaaaattgtaatctaggtagtagtcaaattacctactgtgtaaataggtattacaaaggaatgagagtttgacacaggcaccctctctaatttgtttgttcccatatcctatataaatttcattagccttactcattcatttgtgtatagatgcagggacaaagtccacctgctccaaccagaggaatttccaagcatagcacaagtggtacagatgaaggagaagatggagatgaaccagatgacgggagcaatgatgtcgttgatcttttgccgaggacggagatcaggtaggttccagtctgtgaaatggtttatttcattcattgtattgaattcagaatgttgtcttctttttgaattcagtgaggggaacttaacgtgatatcatcatttttttggagtctggaattaaaggttattttctgtttttcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtatgtagagcatacggctgttctttttatctcccctccccactgctgcaggagttaccttttcagtgtagccttcacttgcaaaaaataagtggttactttatttgctttgaactagaaatagctgcctttaatttattaagtgtatctcaagatatgatggtagttggcagatttattcatcaaatttttatgagtctcagaatttgctttttgcaggaatccaatattgaatatatttgtataaaactgcttgtaatacatgtaaacataatgatttctgatttttaaatgtggatttttatgtcaggatttccttaaactaggttttaccttaaagttgtaaagtactatgatctctggtctaaaattctgataatctagttttacgaactgatgataaaaaggccactgcctaaaaattaattagaataatctaagtcgaatagcatgacaagccagtgtctctgtctcttgagtaggccaaaaatctcctgctgtattgacagtatagcagcaaatttacggaagtttgcacacaacttgcttatcgtttcaacataaagtattggctctttccactcaggtacagcaaacgctgaatatcctgcaacaactggcagtagccatgggcccaaatattaagcaacatgtaaaaaatttaggcatccctatcatcacagtccttggagacagcaaggtaaacctaactcttttcaccatgcctccattctggaataggccagccatatttttgggttaaagataattctctttttagagtcatgtaaagacctgataaactttataaagatgaaaatattagaagaaaaacagtaaacatttttatcttccaggcagtattaaggtgaccaggtatcacttattagttttgtgacttttagataagctatctttgttgagggtcagtttctttatctgtgaaatttctttcttacagaattaaatgagtctgtatgtaaggtacattttattgtgcctgtctcatatagtatgcacacaataaatggttgctattatgattataacgtaattgygtaacattttgctatagtgaataaatatgtgaatttggagttcattaagttattttctacttttatttttctgaactattagagtgggatcttctagtagttcagcaagatatttgtagtttcatagttctagaagtcactgaaatatcattgaaggttacaatgtttagccgtagactaaatatttgaatatctctatactgttgtataatttatttaacttgaggaactttatttaatttaatataatttgtgcttttaatattaatgtaaattaatataaaaatataactaattttcagtcaatttattagcagtttcagtcttaaccattatgatgtctttaacatttagaatttcattctttagcagacagacatggacgtaaatgcccccaactactcaggaaacaaaatataagagttattcttcttacatgatattttatgcccagatcactcactgttttgcctgattaactgagtacacaagttttacaatttggagttttatatttctactttactttggagttttagtacaatcatagaactagtttctgtttcagagaagatggtttcatgtatgttcatgtgggccttagataaccctccattgttcatgttcataaagcaacagtgatcaccccctacctccaaactgtagtagatattatttttgctgattatcttctccatttagaacaatgttcgagctgctgccctagcgactgtgaatgcttgggcagaacagactggcatgaaggaatggctggaaggagaagatctttctgaagagctcaaaaaggaaaatcctttcttgaggcaagaggttagtatcataaattaatcatgtgcattactcatgtcatttacttccataggggcttgggcctgtctgataaatacgcatttatggttagaatgagtttcattataaaacagttaataaaatgaaatcacattcctggggcctttgtattcatgtgcttccattttttcctttcacatgcttctttatcaataacgctttttagaggactaggctttttgtggaatttttcccttttcttaaacatttaaatggtaaaatcagaggttttgtgttttttttattattatttaagctctgggatacatgtgcagaacatgcaggttcgttacatgggtatacatgtgccatggtggtttgctgcatccatcaacccgtcatcttcattaggtatttctcctaatgctatccctccccttgccccgctaacccccgacaggccccactgtgtgatgttcccctccctgtgcccgtacgttctcattgttcaactcccacttacaagtgagaaattgcggtgtttggtgttctgttcctatgttagtttgctgagaatgacggtttccagcttcatcaatgtcccctgcaaaggacacgaactcattcttcttctgtggttgcatagtattccatggtgtatatgtgccacattttctttatccagtctaacatgatgggcatttgggttggttccgagtctttgctattgtgaatagtgctgcaataaacatacgtatgcatgtgtctttatagtagaatgatttataatcttttgggtattacccagtaatgggattgctgggtcaaatggtatttctagttctgggtccttgaggaattgccacactgtcttccacaatgattgaactaatttacactccagccaacagtgtaaaagtggttcctgtttctccacatcctctccagcatctgttgttttaatgatcgccattctaactggcgtgagatggtatctcattgtgttttgatttgcatttctctaatgaccagtgatgatctttttcatatgtttgttggccacataaatgtcttcttttgaaaagtttctgttcatatccttcacccactttttgatggggttgtttgtttttttcttataaatttgtttaagttccttgtagcttctggatattagccctttgtcagatggatagattgcaaaaattttctcccattctgtaggttgcctgttcactctgatgatagtttcttttgccgtgcagaagctctttaatttaattagatcccatttgtcaattttggcttttgttgtgattgcttttggtgttttagtcacgaagtctttgtccatgcctatgtcctgaatggtattctaggttttcttctagggtttttatggtttaaggtcttaggtttaaatctttaattcatcttgagttaatttttatataaggtgtaaggaaggggtccagttcagttttctgcatatggctaaccagttttcccaataccatttattaaatagtgaatcctttccccatttcttgttttttgtcagatttgtcaaagatcagatggttgtagatgtgtggtgttatttctgaggcctctgttctgttccattggtctatatatctgttttggtaccagtaccatgctgttttggttactgtagccttgtagtataatttgaaatcaggtagcgtgatgcctccagctttgttctttttacttaggattgtcttggctatacaggctcttttttggttccatatgaaatttaaagtagttttttctaattctgtgaagagagtcattggtagcttgatgggaatagcactgaatctataaattacttcaggcagtatggccattttcatgatattgattcttcctatccatgagcatggaatgttcttccatttgtttgtgtttgttgagcagtggtttgtagttctccttgaagaggtattcctaggtattttattttctttgtagcaattgtgaatgggagtttgctcatgatttggctctctgtttgtccattattggtgtataggaatgcttgtgattttcgcacattgattttgtatcctgagactttgctgaagttgcttatcagtttaaggagttcttgggctgagaggatggggttttgtaaatatgcaatcatgttcatctgtaaacagagataatttgacttcctctcttcctatttcaatacccttatttctttctcttgcctgattgccctggctagaacttccaataatatattgaaaaggagtggtaagagagggcatccttgtcttatgccggttttcaaagggaatccttccagcttttgcccattcagtatgatattggctgtgggtttgtcataaatagctctaattaaaatcagaggttttaatcagaacataaaaatagaggctgggtgcagtgactcatgcctgtaatcccagcactttgggaggccgagcaagcagatcacttgagatcaggggttggagaccagcctgcccaacatggtgaaaccctgtctctactaaaaatacaaaaaattagctgggtgtggtggtgcgggcctatagtcctagctactcgggaggctgaggcaggagaatcgcttgaatccaggaggcagaggttgcagtgagctgagatcacaccactgtactccagcctgggtaacagagcaagattccatctcaaaaaaaaaaaagtccagttgcagtggctcacgcctgtaatcccagcactttgggaggccacggtgggtggatcacctgaggtcaggagttcaagaccagcctagccaacatggtgaaaccccatctctaccaaaaatagaaaaattagctgggcatggtggtgggcacctctaatcccagctactcaggaggctgagacaggagaatcacttgaaccgggaggcggaggttgcagtgagccaagatcgcgtcattgcactctagcctgggcaacaaaagcgaaacttcgtctcaaaaaaaaaaaaaatagaacattcaaaaatccatcagagtaatcataacaacagaataacaaaatttgtgattatatcaactgatgcaaaaaaggcatttgacatatccaacatgcattcatgattaaaaactcttagcaagtcagtaatgaaagagaattacctcaacttgatrtaagcatctgcataacaacctctacagataacatgaaacttaatggtgagggccaggcgcggtggctcacgcctgtaatcccagcactttggaaggccaaggcgggggcagatcacgaggtcaagagatcgagaccatcctggcaaacatggtgaaaccccgtctctaccaaaaatacaaaaattagctgggtgtggtggcatgcgcctgtagtcccagctactcgagaggctgtggcaggagaatcacttgaacccgggaggcagaggttgcagtgagccaagatcgtgccactgcactccagcctgagtgacagagcaagactccgtctcaaaaacaaaaaaacaaaaaaaaaaaagaggaatcactttacaattagcttactatattgctaatgtaatcaagacactgtgatagtggtagcaggaggatggggtggagatagacacgtagatcattggaacaacagagagaacccagaaatagacccacactaatatcaactaattttttacaaagctacaaaaataagtccgtgaaggaagtatagtcttttcaacaaatgattctggagcaattggacatccataaacaaaaaaatgaacctcaccctaaacctcactgtctcaaaacagattatggacttaaatttgaaacataaaactatagaacttttaagtgcaaactagaaaatctccaggatgggaggctggcaaagaattcttagacttaaaaccaaaaccataatccataaaaggaaagttgataaattggaccacatgaaaattaaaaacttttactctgcaaaaaaaaccacatgaaaataataaaacaagctacagaacaacagaaaagatttgtaagccagtatccaataaaggactaatatctagaatatataaagaactctgaaaactcaacagtaacaacaacaacaacagaaaaatcagaaaatgggtatccatggccaagcctgtgagtagtgagctgagatcatgccattgcactccagcctgggtgacaagagcaagacttaatttaaaaaaaaaaaaaaaagatgctcagtgttattagcaaccagggaaatgcaaattaaaactgtgttgaaatatcactatacaatcatcagaattgctaaaattaaaaataatggtaacgtgaaatgctggagaaacctaaacagtcatgcattgctgctggaaatgtaaaatggtacaactacttcaggaaatagtttggtattttcttataaaactaaacgtgcagttactatatgagccagcaattgcactcttggacatttatttcagaaaaatgaaaatttatatccatacaaaaatctatgtacaaatattcataacaacttcaatcatagtagccaaaaactgggactatagctcaagggtagagcattttactgcataatagccaaaaactagaaacagttcagatacctttcagtaggtgaatggttaaacaaatctcttgtacatccatacatggaatactatttagcaattaagaacaaactgctggtaaatacaataattcagataaatctccaaggaattgtgctgcatgactaaagccaatcccactggcctgcgagccaagattatgccattgccctccagcctgggtgacgggagtgaaaccttgtctcaaaaatgaaaaatacaaatatgaactattttagggatatagagaagaaaaatgtcaacataaggcaaaaaataagaagtcttggtaaaatttgtaaccttctgatcacaataagtgctttgggtcttctagctaaatatttttcagaactaaagggagataagtaaaagtttttcatctttaagatgtattaaagctttataatttaatacccaaatatagtccaaagaaatgtgtccttatcttaaagatgattgtcatcattgcatatgttatttaaatwtagcacagttcttgaattatgaaaagtactgatttcatattggaaagttatagtgtgaaagctaattcagtgcttgagactaatgaaatcagtaagcctgagatcataaatgataacagtcttcatttgaagtgtgtaactagtctttatttcttttggcagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaaggtactacttcttgttgctgctactgctgttaaaagctattaaaaaatatatttaacatgggcctggcacggtggctcacgcctgtaatcccaacactttgggaggccgagacaggtggattacctgaggtcaggagttcaagaccagcctggccaacatggtgaaaccccatctctacaaaaacaaaatttagccgggtttggtggcacatgcctgtaatcccagctacttgggagggtgaggcaggagaatcgcatgaacccaggaggcagaggttgcaatcagctgagatcgtgccactgcactccagcctgggcaacaagagagaaactctgtcttaaaaatatatatatattaaacatgaatttatatgaggaaaaaaccatattacctcctgtgagtctcaatttgaaatcgtaacaagcaaaaataaaatattaagcagtgtagaagtaaaaatctgctgacctcacaggggtgaaaactgtgaccttctagaatgatacctaccttagtgtgacttcataatgtgtgtgacttctctgacaccatgtactgcctcccttacttcagtggtatttcaaaactaggagctcaatcatttgtttgacagaggatttgttcataagctttgtatgactttatcatttatgtgacctctcactttttatgtcattttgtctctctagccaacttctaaagatcaggtattggccatgctagagaaagccaaagttaacatgccagccaagcctgctccacccactaaagcaacttctaaaccaatgggagggtccgctccagccaaattccagcctgcatcaggtaactctatcttaagaaggttaaaggggaaggaaatagccctgaggaactctaaaaagacattcagccttgtcttttttaaatcacatttccttacagcgtagatccaagctctccttccttctctgcttactttcctttcacaaacacttgtcaagtagtcaagtacctattttatgccaggaactgtactaagggtacaaacgtgactaatttggtttctaattctaaaaagttttttttgtttttgttttgtttttttttttagagatggcatcttgctctgtcacccaggagggagtgtagtggcgtgatcatagctcactgcaacctcgaactcctgggctcaagtgttccttctgcctcatcctcccaagttgctgggactacaggcatgcgccatcacacctggctaaattttttactttttatagagatgaggttttgttgtgatgcgcaggttggtctcaaactcctggcctcaggcgatcctcccatctcagtctcctaaagtgctggacttacaggcttgaaccaccacacccgatcccaaaaggagttttggaatagtacattaaaatagtcctttctgaagtgttgcatcctacatttccacaactattttctgctcctggatactataattagaagaggaattgggagaatctagcttaatccactttattaaccttctttaagggataattcttgatttctttatcctgatattaaaattccataataggctgggcacagtggctcatgcttgtaatcccagcactttgggaggccaaggccagtggatcattgaagtcaggagtttgagatcagcctggccaacatggagaaaccccacctctactaaaaatacaaaaattagctgggtgtggtggtgcatacctgtaatcccagctactcaggaggctgaggcaggagaattgcttgaatccgggaggcagaggttgcagtaagccaagatcacgccagtgcactccagcctgggggacagagcaagactctgtctcaaaataaataaataaaaataaataaaatttgataatatataacctgtgaccaattcatttttagacttactgcttaaacaaaacaatattcttgaatttagtggaatagaaattgttgatgctataaagttagaaattttacagcctgagcaacatggcaaaactccatctctacaaaaattacaaaaattagctagtcttggtggcgcacacctgtggtcccagctacccaggaggctgaggtgggaggatcgcttcagcccaggaggttgaggcttcaatgagccacgatcgcaccactgcactccagcctgggtgagccagaactagtctcaaaaaaaaaaaattttacctgtgtaaaactctttattaaagtacatattcagtttttattgaaatcttgctatgtagcagatactgaatatcaaagatgtctttacctttaagaaagtatcagtctgggctgggcatggtggctcacgcctgtaattccaccactttgagaggacaaggaggtcaagaccagcctgggcaacatagtgggaccctgtctctaaaaaaaaaaaaaaagttgttttaattagttgggcttggtggtgcacgcctgtagtcccagctattcaggaggctgaggtaggaggactgttttagccagggaggtcaaggctgcagtgagccctgaacgtgctattgcactctagtctgtgtgacagaaaccctgtctaaacaaacaaatgaaactacagtttaaatgttggtaaatgagatacagattttctgaattaatttctctcttacgcttaaagattttgggagaaaaattattaggaaaaaaaaatctaagccaggcacagtgactcacgcctgtaatcccagcactttgggaagccaaggtgggtggattgcttgagcccaggagtttgagaccagcctgggcaacatggcgaaaccctgtctccacaaaaattacaaagaaaattagctgggtgcggtggcacgggcctgtagtcccagctactagggaggctgaggtgggagaattcattgagcccaggaggtcaggactgcagtgagcaccgtgaaggcaccactgtactccagcctgggagatagagcaaaatcctgtctcataaaaaaaaaactaactgaaaacatcttataaattgatacatttaagactgcaagcttccttgtcatcattatatatttaacctgtccaaaataaaatgatattagttaaagtttatagtatatatatatttttttcctcaaagcacctgctgaagattgtatttccagcagtacagaacccaaacctgatccaaaaaaggccaaagctccaggattatcctctaaagcaaaggtatgttaactctgtatacttcgatgtagacttgcttttaaatatattttatatactgagtcattctattaggaaggatcatattatatataaaagaacatcactgctgttgatattatcaaattatttatacaaatttctgtggttcatttttaataaggtcctaaaacggagacatcctgctctcaagaggtgctgtcatcttcctttcatgtagattttcggggaaagatttactttattgaaagaagaaagggccgggcacagtggctcacgcctgtaatcccagcactttgggaggccgaggcaggcggatcacctgaggtcaggagttcgagaccagcctggccaacatagcgaaaccctgtctctcctaaaaatacaaaaattagttgggcatggtggcacacctgtaatcccagctacttgggaarttgaggcaggagaatcgcttgaacccaggaggtggaggttgcagtgagccaatatctcgccattgcactccagcctggatgacagagcgagactcaggaaaaaaaaaaaaaaggagaaagcatttgtagctctggcataataaacactttaggctgatttggatttaagaaaaggaagttaaatcaacctccttcaaatttggcactgttgtcatcatattagaagatgtttcggttagtctgcagggaaatatcttttgtcccagtgggatttattttgatgcatcagcaattctttcaatattcatggagagttggacaatttaaagcagtgtgttcaaatgttcaactttatcctctgggtgattttttcatttaattaagttttaaaatcacagtaaattgtcattatctctatcaagattgagattaataaacatattcagagtgttaattatttaacacttacaaaaggaaaattgcaaaactgtgcaatgggtaatgaatctaatagtaagtctaaatagagaattatttaatttacttcctgtaattgatgaaaaaatatagagaatgttttttaaccagtacatgtattattacacccccattttggagtacacactctagggcctttcttctaaatattacaattaaccatttttcttccctatgctcaggccctttaactcctcagtgaattaatttaaatgggtaattatcttcaactatccaatgacgttgttcttttcctgtctgcctgtcctcatcccaaatttaacaagtgcttattttagtttagatcacgagtgttttgcagtatttttgactccgttcttaatgccataatttttttcccaatctttttaaacttacgaagcagtttcatataaatgatctcatatttgtttggtctgaatgacattagtgtttatactagaaagaaattgtggccaactagaaatagtggccatgctacatttataataataatgattccagtaatgaaatttgaattttaccttaaatatgtgtactattgtttactattttctttctatctgatatgaagattttaaatcttggattattttttaaaaccactttagtgacttaartatttaaagcatttcttgtaactttctctagaagcaagttcaaaaggtcttcagttacactgttatgataagagatacatttaaatatcaatggaaagaaacagaaaagctttcaaactaagtgtttggaaatgtgtaaatgccattcaagatgtcattaatggctsaggtgggtggatcacttgaggtcaggagctcsagaccagcctggacaacatggtgaaaccctgtctctactaaaaatacaaaaattagccaggggtggtggtgggcgcctttggtcccacctactgaggaggctgagtcaggagaatcacttgaacctaggaggtggagattgcagtgagctgagatcacgccactgcactccagcctgggcgacagagtgagactccgtctcaaaaaaaaaaaaaaaaaaaaagatgtcattaatatggaaagctataaatagtgttgaagatttcaagaaaacaaaaacaaaaagtttgtgacctagactaatgatcagtaatagcagtttttccaactacataacatgccagtccaagaactaaccaacagttacttaagaatattctcagaaaaatttctagagaacctgttcaaaaacatatacaagattctgtgatgcatgtttttttcatgtgaaatatcacgtagaaagatatctctgttttctacagtgcccttttactgggcagcagcatcatattcttaaggagaagtggccaagctaatcagtattccctgaaccttggttgtagagtgcacaagggaagaagatgccaagcaaaaccagcttaaaggaggatgaagacaaatccgggcctatttttattgttgttccaaatggaaaagagcaaaggatgaaagatgaaaaaggattgaaggtaaggaaggattaagaatcgtcaggagatttttgcttgtattgttattcaagaatagttttgctgtctgaattcatgttattgtttaatatctaggaattaagtgtttcttttgcttataaattatattatttagtttatgggagcattaattcctacaaaagaaactatagaatagagttattgcctatttttccctgtaaatagaaataaatgatttagtagcttttttggtatcttcatttttaaaatcaaagaatggaatgtattcattgattttttttttaattaattggatgtataagcttcttcattaatccttctttttaagaccttacaaggcagactttgtgactgtataaatggctagttcagtcatttatgttactttgatttcattagatacttaaatttgttttcaaaatacataatcttttttaaaaattatatgcagtacagaaagtgcaaagtatagtaagaaaagcatgtctctgttccagtatccctccacagggaggatattagtcctcattttttcaatgtattactccagaaatattttatacctctactatcatatgtatatttttatatagccctccttttatacagatggcatatacagacatgccgtactgtttgttctgtatctcactattttcttttaatgatgtttgaaatatctgaaagatcattcgtatctgtgtatatatgtgtgtatcactgtttgtattggtgcattgtatgtatgtacctttctttatccttcgcccactatgttggacatttaggttgtttctggtctttcactattacaaacactgctgctgtgaatatctttgaatgtaggtctttgtacacatatgtgagtgtatctatattaaactcctagaatgatgatatgcataattttgatagatatttcaaattttctctctatcaaagatgtggcagcagtgtccaccatgttatatagttatatgtaggattaattttttttttttctttagtaagaattgcaaggccaggcacagtggctcatgcctgtcatcccaacaatttgggaggctaaggcaggcaaattgcctgagcccaggaattcaaaaccagcctggacaacatattgagacttcatctctacgaaaaaaattttttaattagctgggcatagtggtgcatgtctgtagtcccagctacttggggggctaaggcagaagaatcacttgagcctgggaggttaatgctacagtgatctatgatcatgccactgcactctgccatgcccaggcaacaggtgagactctgtctcaaaaacaaacaattccaaaaatttttattcctagaagattttcagagttgttaagcttcaagaagtatgacaccttgaaatttgcattcatatttaattacaaatgaatattgttgaatttttaaatattttattgttcctgcagctgcattatataaggctctctacctcatttcagttgaacaccctgtagccccttttcaccgtttgttttttccaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatgtaagtctgcaatagataaatatacatgtatttcagacatgtaaaaataccgagccctatgaaataatctgaagtttgcatgacttggaagtagaatatactatgttctctatttttagagctgtcttgttatttggtagaataaatgaatgtgtgtgtatattttttaggtcttaattgaaggcttaaaaatctgtcattttctttttgggctccaataaaatttaaaagacacttgcctagtagaattaagattttgattattcttatttgtgggagttttgttttgttttattttaagcacttggagagtgaaaaagaaggagttattggktgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggtaatgtggtgttctctctctgggagactgcttaagttcccagctgacctcagtttctgtacttttatttcctctcccttttttactgattatatcacggtaccttccctacttatccctatttccctattctttcaaaacatagtaatgcatgggagaatcattgctacttaggaaatgcctcacttaatcattattttccttatcgactaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcaggtgaagcaaacagtttaaactgagatgtgaatctctgcagcagtagcctatagaagaaatagtttatagatgaacaaataaatttctccagtgcctatgtagttgattccaacctcctgatttagactgtgagagtgatgagttgcacactggtggagccatggtatcaggtgatacaggcaccactcagtatcaccctggtgacaaaatcaagtgcacaggggccatctgactcacaggcatctcttcctttcaggagcacttgctgaaataccattttttcactgataaaaggcagtaaacaaaaaatcctaggcagagccagagtaaggttttagtccttcatatatgccaagggaaatttctctagtaaggataagtctctgtcccaaatatgtgttgtctcattaatctagcctttctcccccatcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatgtgagtgacttctctgaacactgtcagcatgtcgtgaaaagaattgcaagatctcctaggtgttaggtttcctgtcctctcaactgtagctaagtttttactactttttagtcaactcaacctatcaatgtgtcctagaatccagatagacccttgaggtgtctctgattaggctgttttaatggaaatcaagttttcttttctgagcattctattcatagcaaatttgctttagaaatgagtgctatttttgaatcaagaaatctgagctagtcccgggtttaaattctgcctggcagtctgctctgtaatttttactgcatcgagtttttggttaaaaagtgcttatttgtgtatagtgtggatgctagtatctgtcagatcacatcttgcgctacagccgtgagccagtttttcactcacattaggttctgcctctgacctcttatttcgtttgagtgagtctggacctccgtcttcagttacctcatagtgtcaccatgtatttacacagggcttaaatatgtttacttatattttctaattaaattctcactactacccagtgaagaatataaagcagttgggaattttacagatgaccaaaaatgaagtttcttgcccatagtcacacagctagatagtggtgacaaaacaaaaaatgaggaagcttcatttaatttttgacctttttatttgtagttactaattggctttcttttttttatcgtttctttttttttttttttttgagacagggtcttgctctgtcacctaggttggagtgcagtggtgtgatcatggttcaccgcagcctcgacctcccaggctcaagtgatcctctgacttcagcctcctgagtagcaaggactacaggcgcgtgccaccacacccagcttatttttatactttatgtatagatggggtttcaccatgttgcccaagctggtgtcaaactcctgggctcaagtgatcctcctgctttggcctcccaaagtgctgggattacatgcatgagccactgtgcccagcccctctccttctttcatatctcctcttcctatagcagctaggcaggtattaatagtagttgattttgaaatgtggtgctttgaaagtaaacatgtcctaacatagaaggttctatttgttttgatatgaaaatagatattattgtgttatccagttaggtttctaaatttggcctctttacagctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaagtatgtagatagagatacttgtctgagagcatctccatggcctttgccttgtgtgctcacagcctgtcctgtaacataatcttgagttcttgtagccattatcatgcatgacagagtgtctgggtaaatgtattgtaaccaaatgtttgattcttcagtcttcattgtctttgtctttgtctcaaaaccacttctaaatggtcttgtgccttctttcactgcttttccgtggacagaattatgtatcgcacttataggatgtaagtactgcctgctaatttctcattagcagggctcttatatctttctaacttctgacttggattcatcccctctggagggtgactagcttagagtttataatcagggtagagggtgtccataagtaccccatgaatcaagtcttccacaaaagttcaatgtcatgtggctaaaatactgattcactttcttctttgtgttatacttggttgtgcttagtttcctattcttgagataaggctaattaaaatacatgcaacccaaaattggcttagggactcaaaatactgcctcctaagcaagacagctctattttgggttgtgtcatgagtataattttaacgaacttgaatttggaaactttgaatccctatttcttggatgtaaagctggccctgacctgtcaagagtgaatattctaaaaaggggtgactggtggtctcacaaaatataaaatgtgctgaacacggcatggaatggtacttatgattagcaaaattaaagcactggttaatttggtggaaaagaaccagccagtctaaatttttcttatatatttgctcataagtagtgaactttgagtcaatacaaatatattttattgttttctgccccttcaggaatagaaatacaaggtttgttggctttagtgaactagaacaaatacttataacttggcaggtaatgtaagtacaaattaaagttatctgccctcttaggatattcatgaaccaatgttgttacctattaaaggcacttgcttagactcagggacttaaatcattcaggggggctgaaaccagaagttgaacatctgtcctgaagctttggggcaactgacagtgctactcttgccctttggttaagaagtctcttttagttcaggagcctccttttgcttcccttagccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagtgagttaaactctttcatttaaatatgagcagttcatgatgatcagacggcctacgtgaaatgtgccctttgtaatgtgcagttaaaactttttagaactgattattttttgaatgatagcagttgttaactaagacctggacctagtggagaattgtataactccaactgactgggatgtcttgtaatagaggttgaagttttctctttgttctgctatctaggatccgggctgtttctccacacttcgatgacatgcacagtaatacagcatccacaatcaatttcattatctcccaagtagccagtggtgacatcaacacaagtatccaagctctgacacaggtaatgggtgtgctcccgtgacagggattccattggtggacatagaggctataaatgtgatgaattgcacactcgcagagtcatagcattaggggatgcaggcagtgtttcatactttcccgaggaaagaaatgcacaggtgccactcagtcatcacttgcctcagaggatgtgactctaatagagccttattttttttttttttttcctcttttgagaccaggtctcactatgttgtccaggctggagtacagtggctattcacaggcactatcatagcacattgcagccccaaactcctggactcaagtaatcctcctctctcagcttcctgagtagctgggacaacaggcttgcatcactgcacctagctaagccttgcattttttataattgcattgattcaccagaggctagagataaaacagcagctaacaagtaaggaccaactctcatggaacttatttagattttagtggacagagacaagtaaacaagaaaatatcacacagttgtaacaactgtgtaaatataacttaaatggggtaatgacggaaaggaagtgagtagatacttagactgggtgatcaggaaaactctgatatccttggggcttagagtatgccaaggagaggaaagagctagtggtcaaaggccttagggcagaaatgagcgtgaagttcaaggaaataagagaaggttcatgtgcctggagcatagtgttaaagggggacaatgatacagaatgagatttgagaggcagacagtgatcatatcatgtagggctttaaaagcaccagggtgagttgtttggattttatttcaattatgataggaaaccattagaaattttttaaaagagaagtcatgggtgggtatggtggctcctgcctggagtcccagctgctcaggaggctgaggcaggaagattgcttgagcctgggaggttgaggctgcagtgagctgtgattgcaccactatactccagcctgggtgacagagtgagaccatgtctcaaaaaaaaaaaaaaaaaataggccaggtgtggtggctcacacctgtaatcccagcactttgggaagccaaggtgggtggatcacgaggtcaggagttcgagaccagcctggccaatgtggtgaaaccccgtctctactaaaaatacaaaaattagctgggcatggtggcgcacgcctatagtcccagctgctcaggaggctgaggcaggagaatcactttaacccggaaggtggaggttgcagtgagccaagatcgtgccactgcacaccagcctgggtgaaagcaaaattctctctcaaaataataaatgaataaaataaataagtaaatgggcttttttttaaggtaagactttagaagtactttgctaataaatattcttacggagaagtttcatatagtgtcttccgctattttagaagtatgaagcttggaaaatatatcttgaaatttttgttatcagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcggtaagggcacctctgcagaatttcagcttcccatcaatctctcagcctacagaggttcaaaagccagagtccatgcagatgttgcagtgagtcctgtgtcacttggtagaattttacatgcattgtatatagcaagctactgatggcttccattggatgtttggctacactccatcccaccttactgttaggatataaagtaacatgcttacagactacctagcttcttccggccagtttcttcatcaggcatggtaggccrtagctgcctttccacagataagtatggttctattaaaaatgctaattagcctggtttgatcagtatacattgtatacatgtgytgaaataccactctgtattccataaatttgtacaattattacatgtcaactaaaaataaaagggaaaaaatttgttaatgttttacctgtagagcagattataaggataataaagacattctcactcagatttcaatattctttcttaaactggggctaaaagggtggacttaatgacaccaactagccagaaattacaaatttggcataacagtaaataatttcacatgtaaaaacaaatactttggccaggcacagtggctcacacctataatctcagcacgttgggaggccaaggcgggtggatcacaatgtcaggagttcaagatcagcctggccaagatggtgaaaccccatctctactaaaaatacaaaaaattagccaggcctggtggcgggcgcctgtaatcccagctactcgggaggctgaggcagagaattgcttgaacccaggaggcggagctttcagtgagccgagatcgtgccactgcactccagtctgggcaacagagcaagactctgtctcaaaaaaaaaacaaaaaatttcacaattagaagcacaccgattaattttgcctattactagaggcttgggggagtgtggtgattttgttttttctttaatactctgaatttttacaaatataacatagccgggcgcggtggctcacgcctgtaatcccagcacttcaggaggccaaggcaggtggatcacgaagtcaggagatcgagaccatcctggctaacacggtgaaaccccatctctactaaaaaaaaaaaatacaaaaattagcccagcgtggtggtgggtgcctgtagtcccagctactcgggagactgaggcaggagaatggcatgaaccggggaggcagagcttgcagtaagccaagatcacgccactggcactccagcctgggcgacagaggagactccgtctcaaaaaaaaaatacaacataattgaatatttatcagaatatgccacccacatttctttactctctatattgagttttacacctccctgacacaagtatgtctggatagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgaggtatatctgtactctcagccaatagagcctggggcatcctcgcttttgtttacacttagaaaccataatgtccgtaagtcaacttcctaggcaacctaacaatcataatcaacttcctaggcacacttaaagttatagctacatcagttataactatatcagttaaaactttaagtgtgcctaggaagttgatttattactcttcttcatcatggaccaaaggtattttagcctgagaccatagctaaaactagtaaatacttagttagccagccaatatcatgcattttctataataggactgtaaagtttgtcagttacatttttcttgtacatttcaggtacattttattctttctcagctaccaatgacaatgaaaaatagagtcacaaaccttacacttaccaagtggtgacttaaaaggcttaaacaatgtttattttcttaactgaatgtcaggtagtccaggacaattcctgatccatgacctctcagtttattagatgaatagagtaatctcacttgccctttcaactgctgattctaattggaatgcaggtttgaaacttaatgctgttgtgttgggtttttcttccagtgccctacttgttttgctccaagacagcctgctagcaacagccagttctcccaaattctcagagcttgttatgaaggtgaagttgaaatgatttgatctcttttctttcaaagatgcaatcactttgttaaaagtatggggaaagaggaattggagctaagaaagacataggctcaaatcaaccaagtcacacctgaaaatatatttttcgtaataaaaatattaataaatttttaaaaatttagccaggtgcagtggcatgcacctatagtagcagctactcaggaggctgagttgaggagattacttgaacccagaagtgagcttgatcataccactacactccagccttggcaacagtgagaccccatctcttaaaaaatatatatatggttttttatatatatgtgtattatatatatgtatatatgtattatatatgtatatcttaatatgttatatatgtatataatacacgtgtgtgtgtgtgtrtgtgtgtgtgtgtgtgtgtgtgtgtgtgtrtrtatatatatatatatatatatatatatgaattggtcttcagtttttcccttcctacaatttatattctaagttcaggcctaaacagttcgtggcctcaaacagtgaaagggaggaaatattttgtaaatattttactaattctctgaggatcaaaaggaaagaagtttgaaacagatttcatttattttggggaaaaagatatctacagccctatgatatttggtctcttttgtgaaagagaccaaatgaacatatttataacattgtaatactgttattacactgaattagtatcagatattttgtccccttgcattagatttggttaagcaacatgaactactttactctcaggaacgaaggaaacccaagagagaatttctrccaggttaaatgatggcccctagctctggggagtgggaaggagtagagatggatgattagatgaatgactggacacacttcagctggtgtcatggtagaagtgattaaaaattttcatgttttagcagctgaacttgaaagatatgatgtgccacatttatagccctggccatcttttagaagtgagctcaaagcttagggaagatgaatggtgacaaattatcctcattcttcagtcactcctaactcttttattcttttttcaatagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaaggtgagtaagaatcgcaactggtctctgagggagcttgagagaaaatcatggaaatggcagtgctatcagtcatgcatgtgtctccctcagatcctggaccacctaacgatgatcgacaacaaaaacgagtctgagctggaggcccatctctgccggatgatgaagcacagtatggaccagactgggagcaagtctgataaggaaacagaaaagggagcatctcgaatagtgagtggcctgacttgaaagattgagggacatgaggctacaccggaagtgatcttatctaaggtgtaggtcaccaggatatgctttccgaaggtccaaggtgaaggctcatggactggttgaatcagtctcctgctgtggtgcagtaaccatttccaccttgaaattttaaaatctaaactaagtataaccatgtgttttttggtccccaagaaagatgcctaaggcattggtcaccagataaatagctagttctgcttaacatggaaagaatatgtcagttccttctccatcaagttgaggtggaaatctgagactggaggcattcagtaacacagaatgttagtgcttctgctgcaagacctgcatcatcggtgcatctgttatctgtaggaacataccaataaggcccagattttgagatattttctgttcatatccaaccatcagttcctaattaataactcaagtctaaccaattcttcctatgtctttcaacttttcaggatgaaaaatcatcaaaggccaaagtgaatgatttcttagctgagatttttaagaagattggctctaaagaaaacactaaagaggtgagagtgaaagggttaagcagaataggggtctgctttatggtaaagggacactaacattcatccccacctcttcccttttcctgttcaccagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggtatggtttcctgttatagctccaggaataagctcaaaatagctcctagcacaggaacctgaagttttggttagtttaaattcatatccatgaacctcaatacttaatggtcaccaaatggccttcccattgctatatccagtggtcaattcttagccacctgaattgacccatcatcagtatttgacaatggtaaataaattgttccctgcccttgagacagcttcttcacttcgcttccagttctccatgctgtcttgttttcctccagtctcactggctattccttcttggcctttgactgattcttgctcacttgctctgacctctttttttttttttttttgagatggagtttcactcttgttgctcgggctggagtgcagtggtgcaatctcgggttcaagctattctcctgcctcagcctcccgagtagctgggattacaggcatgcgccaccacgccaggctaattttttgtatttttagtaaagacggggtttctccatgttaggctggtctggaactcctgacctcaggtgatccgcccgcctcagcctcccaaagtgctgagatgatgctcatgagccactgcgcctggcctcactctgaccttttaatgtggacatcccccagggttcagtctatggttgtcttctctctttctcttatttccttaatgagttcatctactttcaccactttaaataacatttaaatctccagcttagacctccttcctgatttccaaactgctatatcctacatgatatctccacctgggtttcaaatagattttttttttttttttttttttcttgagacggagtctcaccctgtcacccaggctggggtgcagtggtgtaatctcagctcactgcaacctccgcctcccaggttcaagtgattctcctgcctcagcctcttgagtagctggaaccacaggcgggtgccaccacacccagctaatgtttgtatttttaatggagatggggtttcgccatgttggccaggctggtcttgaactcctgacctcaggtgatccacccaccttggcctcccaaagtgctgggattacaggcttgagtcaccatgcccagcctcacatagacattgtaaactctacatgtcaaaaactaaagtcctggccaggcatggtggctcacgcctgtaatccaggactttgggaggctgaggcgggcagatcacgaggtcaggagttcaagactagcctggccaatatggtgaaaccccgtctctactaaaaatacaaaaattagttgggtgtggtggcgtgcgcctgtagtcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatttacattcttctccatcttggttgatggcaactttatccttcgagtttgttcagatccaaagcttttgagtcttctcttcctttccgtcaggaaattattttggctctacctgcaaaccatatgcagaattcatccacacttctcttcactgctaccaccttggtgtgtgtgttctctctcatctgtattactgtactatcttcctgcttgatctccctgcttccaccctgccttcctctgttcttttctacacatagcatcagaatgactctaatgaaacattttccagaggctctccctttcactcagcaaaagcaaaaggccctttaaaggtctctgaggtcctgtgtttataggacccgccagtgcccctagtacctcatcacctagtcctcttcctgttgtttcactccagccccaccagcccccttgtttcttttagagtcagggtctcgctctctcactcaggctggagtgcagtggcgcaatcatggctcactgggttcaagcagtcctcctgcctcagcctcccgagtagctgggactacaggtgcatgccaccatgcctggctaatttttgtattttttgtagagacagggtttctccttgttgcccaggctggtctctaactcctgggctcaagtgatccacccacatcggcctcccaaagttctgggatttcaggtgtgagccaccacgcctggcctccccctggttgtttctggaacacaccaggcatatgtcttcttagggcctttgcactggctatttcttacacataaatgctcttccttagatggctttgttgcctagctccctttcctctttcacatctttgttcaaataccaccatcttagtgaaacctttttttttttttttttgagatgaagtcttgctctctcgcccaggctggagtgctatggcacgatcttggctcactgcaccctccgcctcccaggcttaagagattctcttgcctcagcttcccgagtagctgggattatagacgtgcacctccacgcccagctaagttttgtagttttagtagaggcggggtttcaccgtattggccaggctggtctccaactcctgacctcagttgatccacctgccttggcctcccaaagtactcccaggcatgagccactgtgcctggccagtaaaaccttattgtttaaaacttgcaacctatccctcaccccaccatagcacttacacctctaacatactatataatgtagtatttattaggttaattgttcagcatctgtgtctagtcatgcatatcaacattttgcccagtgatggactgcatatatgatggtggtcccataagattatttattttgagacagggtctcactctgtcatccaggctggaatgcagtgacgatctcggctcactgcaacctccacctcctaggttcaagtgattcttttgccttggcctcccgagtagctggacagttgcgtgccaccacacccagctaattttttgtgtgtatttttagtagagacagggtttcaccatgttgccccagctggtcttgaactcctggtcttcctggtctcaagtgatccccccacctcagcctcccaaagacctaggattacaggtgtgagccaccatacccagctggagctgaaaaattgctatcacctgatgataccatagctgtcataatgtcatagcacaattatttttgtataagtttagtgtagcctaagtgtacagtgtttataaagttgacagtagtgtcctaggctttcaccttcacacaccactcacccagagcaacttccagtcctgcaagctccattcctggtaaatgtcctatacaggtgtaccatttatcttttatacracattcttactgtaccttctctatgtttagatacataaatactttgtgttaacattgcctatagtattcagtacagtaacatgctgtacaggcttgtagcctaggtgtgtggcaggttataccaactaggtgttcacataacaatgaaattatctaacaaatgcatttctcagaatgtatccctgcccttaagccacacatgatgatatttgttaaatgatataaatgaatgcagtaactaagtttaagctgaaatgttactgcccccacagtgaaaaagtccctattcgagaattactgctcacaggatctagagacaaacagaagacttaggaggtttcagttatagaaaatagctatcatgagccttaaaccaagacaagacagacccaactgcaaaagtgccctctcatcagtcctatgcttagttctttccgagtttagtgacattcacctactcttacatttgagaatgtgtttgcctgtcaaagcatgtccctttgtgtttttcagaccctgatcatatccactctcagcctgtatcttgctgggctgaagcttcagttaaattttgttctcttaaataggagttcttttttgtttttgacaccttaaattacgcctttccaagactttacaagtgtttttattttttgaggtttttttgagataggttctcactctgtcacccaggctggagtacagtggtgcgatctcggctcactgcagcttctgcctcctgggttcaagtgattctcatgtcttggcctcccgagtagctgggattataggtgtgtgccaccacccccagctaatttttgaattttttttaagagggtttcaccatgttggccaggttggtcttgaacccctgacctctaagtgatccacctgtcttggtctcccaaagtgcttggattacaggcatgagccactgtgcccagccagggtctctttttgttgcccaggctggtctttaatgaaaaagacctcttaggagttaaagtgtggtgtgcagaatgtccaacagtatgccacatgtaaacataccatggtttgatcagggcaggcatcctatccttgtttccaaagccctttttggggatgttcaacgtgtgataattttggcctaaacagcacatttgcaacccaagcatgtattcccactgattattaaattgattttgtgccttagagtattcagacatctcatattgctggcttttacataattcttcattcatttttcaccccctcagaggattctcctcatctttacattaaaggagtcctttttccctggagtaacctttctacttttctatttaccataaggcagtgtttcctcccagtaccttacctttggggcctgtggaatgcatttgcattgataccaagtgaaatattttaaaggcccgcattgtatcattgttcattctcagaaatttaggaagtgtgatggattttttgttgttttggttttcctctctcctgccagaatattgatcttagtggtagggttacagacactccagttctatgccctctttagataattgttggacaccttctcttccccatgaatacaccatagccttggacaccttgcttccttcacaggttcaaatgagtttctcctatgtgacattggtccaaacttaatctaattcttccaaacatttaaggtcctcgggtttttcagttgggcaattacagtatgcttaggagtagcttcagctttttggattgcccaagtcagccctgggattactggagtacaatcccctgcataacccaggatgcagatggatgacccaatttacattctgcctttctatatcagttttttgcattctcaagaagcttatattgtatatttcagagcacccttatcaccaactccaggtagattcttgtggaatttgtcgttttcaagtataggaaattcttaattgttctttttggtgggagattaaccaaggcactttagaagggggatatgtggatatctgaatattctttctactttttcccctctaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaaggtactgctccttttcttctgtgcagttcagggagggtagtcacaagcaggtccgaggcaggctggcccacagagaagtggcttagtcttgctgtagttctggagctgcatcttgacctgcttgacctgaccttagacaatctctctccttctctcaatagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcckccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctgactcccaagatgctccatatcatggagtgttgggcagcaattttttaacttttggtaccagctgggtattcagccagttagagaaaggttaattactgcttacagagcttccctttttcttggctcacagacttggagctgtcttttattcctttggaatggaaggaactctccttccctgctctccacaaacagctcctagggagcagaaaaatctcatccttccttgttttgagattttggtcatgatttccctccaattatcaccagtcgtttcaagaagctcttgggcatcctaccactttgctgaccaaaggcacacaagattgcgcccagagattggctgggcttcagtggttctcacactacaactagatttgtgttcatttgactaatggagtttgggaaatcttagtggtttgctgcttggttgtatgagtctcttttggtccaggctaacagttgcttcacattcagtcagagtaaggatgagaaagtgagctgagtattcacctctggaataaattccacaggacctccctccacagtcagaaaaactcttcaggatgaaaaggttctggattcaggaggagattttgggcagttataaagttcaaaggaactttcctattgtagcccaccttcaattcaattgatgtccaagaaatgaaagattgatggaagattaatcctgtaaaggttccagtcatcgttttcaggtggccccggagcctcctgaaattaaacttgtctctcctttatagtgggaacatgggagtgggtatttgttcactgaagggatgatggaggcgtttgctgctatagtggaaagacatatttagaaagaatggctacaaaggctgggcctggtggctcactcatacaaccgtagcattttgggaggctaaggtgggtgaatcacttgagcccaggagttcaagaccaacatgggcaacatggctctaccaaaaaaatacaaaaattagctgggtatagtggctcaagcctgtagtcccagctacttgggaggctgaggtgggaggatcacctgagcccaggaggtcaaggctgcagtgagccatgatcactccactacagcctgggcaacagagcaagaccttgtctcaaaaaagaggagggaaacaaaagaagaggaaaaaaaagagtggctgtactcctgtctggaattagcacagctgactggaaaaacccaagtccctagagcttacaacactgaccgctatgtcggaagaaaacagacttatgagaatgtgtgttcttgtttaaaaagcaggtcctgcatgtcacaagtaattctgaatcccttcccccttgatcgagttgatgccctgggctgccaaatcctgcaagctcactgcctttcagtcaaccagaaccaaagaatgaggccaaggaactctgtcctgtttgttttctgatgtgttgaaaaatgagaaaaaaaaaaaaacgttatgaggagggtgctaaagatccctatctcaggtcccttcccgtggaaaaccacgttagaagatcctaggccaggtactgtagccacagggtttccctgctccactccactatcctgtgcctgaggcagacgttgatcttcattctttccctgagctcatggatgagacttctcaagacggagccatgctccatcccacacctgtgacctctgccaacagtaaccgtgaagaatgtgctctgaaagggtatctttgaagttctatgattcttttttttgcaagggactcttgctgtgtcgctcaggctggatggcatgcagtggcatgcctctctcctcactacaacctctgcctcctgagttcagccaattctcctgcctcagcctcccaagcagctgagaagctgggattacaggtgcccaccaccacacccggctagtttttgtatttttagtagagacgggattttaccatgttggccaggctggtctccaactcctgacctcaggtgatccaccagcctcagcctcccaaagtgatgggattacaggcgtgagccaccatgcccagcccatgactcttataacttagaggtcccatttcttggaaaaataaattgttccagctgggaactgctgtgtgaggaaacattccaggaagcaactaccccactgatgggctatttccagggcccaagagagggacgaggtaagcggcagaggaactttcaacaggcccaatgcccggtccagttcccaggcaatagtgagaatacgagtggtagtgattcacagcttactaggcactaggcattgtgctaaggcaccatgtaagttctttcatttaatcctcataaccgtatgaggtaagtaatgtcgttatatacaccttttaatatacaggtggccttccagatctgtgggttttgcatctgcagattcaaccaactgcagattgaaaatatttgtggggaaagaaaacaataaaaataatacaaattttaaaataatacagtataactatttacatagtatttacgttctattgggtgtaagtcatctagagatgatttgaagtatatgggaaggccgggcagggtggctcatgtctgtaatcccaacactttgggaggccccgatgggtggataacctgaggtcaggagtttgagaccagcctgaccaacacgttgaaaccccatctctactaaaaatacaaaaactagccaggcgtggtggcgggcacctgtaatcccagctactcgggaggctgaggcaggagaatcacttgaacctaagaggcggagattgcagtgagccgagatcgcaccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacctcccaggttcatgccattctcctgcctcagcctcccacgtagctgggactacaggcgtccaccaccacgcctggctaattttttgtatttttggtagagacagggtttcaccgtgttcaccaggatggtctcaatctcctgaccttgtgatccatccacctcagcctcccaaagtgctgggattacaggcttgagccaccgtgcccagccctgatttttataaacagggtttcactgtcacccaggctgcagtgcaggtgtagtgacatgatcatggctcactgcagcctcaacctcctgggctcaagtgatcctcccaagtaaccttgactacaggcacatgccaccacgcctagctaattttattttttggggtctcaccacattgcccagactgatctcgcattcctagcctcaaccttagtctcctaaattgctgagattacaggtgtgagccaccatgccctacctgatctgatatcattttaatgatacaagggaagatgtagggagttaactaaaaaagcaccgtcctcactcaatattttctatatttgaagtcctactttgagctttcttagccatgtgactttggacaaggtacttctccaaatctcagtttactcacctacctcttgtgaggattaaatgagataatccattaaaacccagagggtggaacatctttaatgcctgtaaattcaacctgccatctttcctctcacctggccctgctctgaagatagatagtggattcttttgggacagggtctcactctgtcacccaggctggggtgcagtggctcactgcagcctccacctcctgggctcaagcgatcctcccacctcagcctcccgagtgctcggactaccagcgtgcaccaggtggtggattcttaagtcttctttatccagtagtattactggctcttcctgagcccagagagctgcccatgaatagcactgggagcattgaggctcgctgagagtcacttttattgggaaccatagttttagaaacacaaaaataattctttcacgggattggttccaggagcccagaatatgagtggccccctactctccaaactgatcaatgaccttctgtatccacttcttcaggcggaacacatgtgtgtagaagccatatttcccatcccggtcacagccttcaccccatgagacgatgcccatttgataccagcggttgttaaaggggctctgaagaagaaagatgaggtttccaatagagtcaagttcaaggtcacatcagtattcctctgccaggcaactgtttctagatactagagtttctccccacccccagaagatgtgttcaccaggccctgggctttagagaagcttaccttcatgacaaagggtcccccactgtcaccttcacaggcatcccctcgtttcccttcatcaggcttgtaaccttgaaagagaacagccgtctgtgctcaggagcatagctcatagcccagccacgccccttcacgagacacagctggtgagagtccacttacccctccagtcattcttgctgtccccacttcctcaccctacacatccaatcctagcaaatcttgtcggctctaccttcagcatagaccccaaatccaaacccttctcaccacttctagctcgagctcctgaacccactagtttccttcattctttgcccacctacagtctattctccacccaacaggcagaataatgcttttaaaaagttggaccagaccaggggaggtggctcatgcccaagccgggtggatcacttgagctcagcagttcaagaccagcctgggcaatatggcaaaaccctctctctacaaaaaattagctgggcatggtggcacatgcctggagtcccagctactcgggaggctaagagaggaggatcacttgcacctgggaggttaaggctgcagtgagccgtgatcatgtcaccacactccagcctgggcaacagagtgagaccctgtctcgaaaaaattaattaatgataaaagaccaagaaaaaaatttaaattaaaaattaaaaaattaaaaagttagacctacaagtctgatgaggataataatgatagttgcttttatccaaatctccccacgtatcctctacaaacaatacagaacaacactaacaacagtaaaacctacacaaaaaaaccacactttcactaggtgctgtggctcacacctgtaatctcagcactttgggaggccaaggcgggcggatcatgaagtcaggagtttaagaccagcctggccaacgtggtgaaaccctgtctctactaaaaatacaaaaattagccagacatgttggtgtgcgcctataatcccagctactcaggagactgaggtagaattgcttgaacctgggaggtggaggtggaggttgcagtgagccgggattgcaccactgcactaccgcctgagcgacagaacaagactctgtctcgaaaaaaaaaaattagccggacatggtggcatgtacctctgatcctagctacgtgggaggctgaagcaagaagaggattgcttgagcccaggagttcaaggctgcagtgagctatgactgtgccactgcactccagcctgggcaacagagcaagaccctatctgaaaaaaaaaaaagctagcaagagaacagcaaagtaaaccagacaaaaacgtaagcaaactttttaagagaaaaaagcagaaattaatgaaccacaatagaaaaataataggcctggccgggcgcagtggctcacgcccgtaataccagcactttgggaggctgaggcaggcggatcacaaggtcaggagatcgagaccatcctggcgaacg

SEQ ID NO: 12481 - DNA, 59234 bp, Homo sapiens
  misc_feature (1)...(59234): n = A,T,C or G, or insertion/deletion polymorphism (see Tables 1-2)
tcttttttagagtatccaggtttggtgattttgcactctaccagaattccaatgcaaaatcttactgttctatacagatctactcctatccaattatatcaaccaatacaatctcatttttgtttaagccagttttatttggtttcctgttaaacacgactgaaaaatcttaactgccaatgtggagatatcccccttcatgatgttgtaataatggctgcagcagctccaggtgtcaaatgcagacatgacatccagagaagaagtggaatgctgcctgtcatccatctctgtttattaggagtgaaaatcttttctataatttctaattcagaaggccagggttgtaatcacacactacatggaatgggatgggaatgattaccaaacagcaatctttacttatccctgaacttggggagaggatcatctttcactagcaaacaactacagtagaagaacatccaaataaaactgggactctgccagcaatataaaatatgaaaggggaaagctattgggtaaataatcaacagtgtttatgacactaatagatgtattaattttctgtaaagttgtgtgtgtgggtagaaaatatcaggaattgtacatatcaatctttagcagaatttaaatttgggagggggactatctggagtggaaaggatggatatttttacttatacaattttcattagtttatattactttggtgatttaaatttaaaagaacttcaatctaaaaatgggctgctcagaagtagagctagaacaaaaatatagagtcagaaggctggatatggtggtccacacctgtaatcccaatgctttgggaggtcgaggcaggaggatcactttaggccagactttgagaccagcctggggaacatagtgataccctgtctctacaaaagaaaaaataaaaagaattatgagcatggtggtgtgtgcctgtagtcctagctacccaggaggttggaggattgcttgaacccaggaggttgaggctgcagtgagctatgattgcaccactgcactccagcctgggcaacagagtgcttgtctctaatacatacataaatatatgtatgtgtgtatatatatatatgtgtgtgtgtgtgtgtgtgtgtgtgtgtatgtgtgtgtgtgtatgtatatatgtattagggagagagagagagagagagagagagagtcagagaagcacatatttgtatattccatcccagtcctggcccctacacagttactcaggtgccagtagcaggtttattccttctggggatttggaggcacaaagctatccgagcctgatgccatcaaatatttaaaccattcacctccctcccgtcccactctcaaagctgtcttcacatcataaattggcttcctgtgcatattttcctacggggaaagaatgtgctggacatggcattgtgagcattctggtccccttggcagttctatttctcatcataaattaatacattgcttctctggctcagatagcaggataggagctgggttagtaggatctactttccattccccaatagataggttctctcttaatgctgttaaagtcaagttcataagcctggaccatgatgaatttaccaaggtaaaagtcacctctgatgccacttgtcagctggccagccagcctgccctgatgacactcctgtctcttcaagcacatttctttcagactcctgtgcttcctagccacattcatctcaatcagctgtctctttctttatccctcattctgtcttttcctctatgactctctctctctaattatatatatctttctctcttcctacttcaccacttaatcttcctttatctttttttttttatttgacggaatttctctcttttttgctctggctggagtgcaatggcataatctcggctcactgcaacctctgcctcccgagttcaagcaattctcctgcctcagcctcctgagtagctgggactacaggtgcacaccactatgtccagctattttgtacttttagtagagatggagtttcaccatgttggccagactggtctcgaactcctgacctcaggtaatccattcgcctcagcctcccaaagtgctgtggttacaggtgtaagccaccgtgcccagacttcttttccttttttcttctgttttttgtttgtttgtttgttgttgttgttgtttaccttaattaaccatggagttgaaaaataatatataccagagctatgtgccaagcacagagctgggtcacatgtaaaaattatattctgacctcacaataactctgaaaactgtttttgttcctattttacaaagaaagaagtggaggctcataaagggtaagtggttgtgtttcataatcttaaaggttttctctggtgaattttcaaaattagtaaattaaatgctttgtgcttcctttatctaagaaaatacagtttaggccaggcatggtggctcatgcctataatcccagcactttgggaggctgaggtgggtggatcacttgaggtcaggagtttgagaccagcctggccaacatggcgaaaccccatctcgactaaaaatacaaaattagccagctgtggtggtgtgcacttgtagtcccagctacttgggaggctgaggcaggagaatcgcttgaacctgggaagcagaggttgcagtggactgaaatcaggccactgcactccagcctgggcaacagagtgagacactgtctcaaaaaaaaaaaaaagatgaccctttgaacaataaagctctcactgctctttgcctctccccatccttcttcctgagagtgggacttgaccctgattcctctgacacaaacttaaacttctttatggaggagataaccttctctgtccagtcaggctcaacatactttctgtatctgtgcaaaaggaagaggtcaaatcttcagcacctagatttgtaactttcagtaacttggagatggaggttgtggtaacattaaatctgctccctggaaggtcactttttattattttgggtgtttaattaagttgctcggcctcatcaagtgtcctccccatgatcctagaagatagtgaggtagaagtagagaggagtatcccttccagcctgcttcagtagagttctgagaggagcaaaagagaaaacaagatgtttctgggtgggttccaggcccctccacccttctgcaagggagtgaagggtgcttatctcctgaagacatgaattgatggattttggttataggccggaggagcagatgcaaccactgtattttcttaggtaaaggaaatataaagcatttaatttactaattttgaaaattaagcagagaaaatctttaagattatgaagcaaaactacttactctttatgatcctgccaaggatcagaacatggcagcagagaagtcccaggtctaactgaatgtccagactctgttggattcagcaccatagacagaaagcagcccaaagctgctgagggctgagggttgaatgccatagacagataccccttctctgtccccacccccaatttcactagtccccattgctattcctgggaggaacctaaccccttccattagttaactggcccccagcacttaaaggtcgagataaacaatgggttggtttccttctaaggccctccggaatttctttactgagctttcagttctgcggcttcctggtagagtggggtccgccttagagcaactcttattaacatccagctgatttgcatatatctgcattcactggggcttctccattctggttttattgtaaatgaattgctcagaggaagaaagggaaggattatttcactccttttttttcctcttctttccccctattcctagggtctctgtctggaaatttcccccagatgcgtgaaggtgtgtgtggtggaagagggtagaaaccagactccaacagtcaggtatttgccagagcatcctatgtagatttccccagataatttcccccatctgtttggtttctgaaagatccttgtcaggttcagaggaagtctgtattttgttttagcaccgagggtcagaacctctgggctgaagtccctggagcttcagtaagaagccatgattggtgccttagagcctgctaaggggatggaacccggttttaaagaggagtgaggggtggtggagtgaggactcattttgaaatgaaaggagtcctgggtctctaagcagcttctaaaaataccatctcccagaggtggaggcagggggaggggagaaatcgagcgtgaggagaatgaagatggaaaggaggtggcagtgtgagaacccttcctcaggtaggtctggttttagaagtcccgcctgcatccaaggactggagggatgccacacctccttctgcttcctcagggggcttgtctcctgtggtgtccaagccacagcctctcctgatgacctttctttctgcaggtaaagaagaccaattcctcccacctactcctcctattgctactgtccagcaagtatgtctgagtgggcacgtgtgcatttactcgcacatatacacaagcacacacgcagaaatggcacatgaaagcgggttgtaaatggccagtgatctacgatgccaggaatcctccttacactcggcgttcaaagaggtatggactctggcagagacagcgtggttcaccagggcatccgcagcacagagcatggcgcccagtgagggctgggtagaggggtgagggatacatatatgcaaaagcacagacactcagaccgcaggggccaagtagtcacaggactcacactcactctcgaggtttctcaggctatattcgcttccaaatagagagggggtgggtcccccaagaaaagagctcggaaaagccacgaggtgggtggagctttctcccctcaagttcagcccagatggtggcgctcagtagccgcctccctcgtcctggagggccccaacccttcccaccaccaaagtgttaaaccctcagcttgcacataaatgaccttcactagacagaggtcttgttccacgttttcttgcggcttcttcagcgccggctgaactctgccaggattgctccgcctctctcgcagatgtctccgattcctggcctctgtgctgttcaccagtcccctggggtgggcggagtggggtgatcaaagaggggaacccccgactctgagcagactgagggcatgggtggttgtgaggtgtgctgcttgtatcttgacagcaggagcaagaacctgaggaaccgatcgttcatgcaaaaccgccaccgcccccatcccagcgtccacatggtttcccagcctcggaagcgcgttggtagggcaggaccccgtccctcactttgctctcctttcccgagcagctcccgggatcgttcggcccctccttcctgccgctgtgtgtgtgtgtgtgtgtgtgtgtgtgtgtgtgtgtgtgtgtgtgatgagggcgggaagagaaagggggggatgagctaggagacaccgggagcctcagacacaggaacagacctagggcagggagacaggagagctccccagagcttggggtcaggacataaagcttcaaaaccccgcaagtcctgggaacaagggagctttcagactagctcagaggctgcaagtgttgctgcctccccgagggtcgcccctccttaagccaagcccaccttgcctgcctacttctcaggaatgaggagctaaggtttagcgctctgggccaccgatgccagctcattcccctctcgcagaagccctgccagctcccacagctgccccaccccccacggtttggagatctgcgggaccccttcctttccccaccagttgggtgttccgcccctggcctatgaaactccaccttcccaccctctgctggcggggattggttggcatcccgcggcggtgcctagtgattggttcccatggatgatggtgagcggtgagactccgccccccgctggctctggggtctgggggcattgctcagcggtgctaggctggcgcggcttgagccgccgccggactkacagctcggtctgcggaccatggagacctgcgccggtccacacccgctgcgcctcttcctctgccggatgcagctctgtctcgcgctgcttttgggaccctggcggcctgggaccgccgaggaaggtgagaagactggtgagctctgctcggagcgtggcataccaaaagatagggggctggcgatgggggttctgggggaaggagtcattgsagagactagagtctgtattggggcttgaagcaagcmggcagcaaagaactggagagacagagaaaaatgtgatcaagcagtagcgaagagaggggcgctgaggagcttgggggctggagacccgggaggttgggaaagaaagaggccaggaaccgcgggagccagaggcggcggtccagcggccggtgagacggacaagctgagtgattggaggtgggaggtgcgggggcggggagatgaagagtggagacagggagatgcggaggtgagctcggaatatggggagacgggatggagcccggactacaggggctaggagaccacagtgtggccaacagaaggtggaatgctggtcgagggggctggatccgggcgctgcccgacgtgctgatcatggaactgtccgcagtgctgaattctgagcgtagtctgccgggcgcgctccgcgttgccgggtttgaggctgtcggcgatactggagcccgcgtcttgcctctgattgtgcatttaggggagctatacgctcagttgaatccagaggcgtcatatctaggtgcagaatccggaggagctggaatctgaggcgttgaccgcggggttggtctgggccctggatggctgatgccttccagttcgcgattccgatgtgctgtcagttgcgcggatctcggaaagccgtcggcggtcctgcccacagtcgctgacgcctctggagaggccctcaccttggtggcccaccccctggtttaagctccagagggtaatctcccaagactccggggtgtcctgacctcctgtctctggtctgcggactctgctgtccaaaccattttctgtgatccatgctgagaggttgcaggctgctgatccgatgcctcctgggggaataaagggacttcaagcttctctggtaggaagggtcatagatgtatacataaaagaaccccagacattctttcaaaagcagtggaagtgacagcccctgggaaaagggctggctgaggagaagagagattttatttctccagttgttagcagtatctctccacattgttttctcagaggcccgggagtcagtctaaaaatgttcaagtcttcatgcctggggaccaccgacctcagaaaagcccctgagtaggagtggattggggggtatatacaggaatcccctgatacattcactactcactttctctctctctctctctaattgactcttagctataattttgggaacctaagaaggctggggagagtcactgactcccacccccaatctgagagccaaccttagagtatttgccatggaccctgtagaaggctgaatgatgacccccacccccaatatgtcaatgtcctaatccctagaaccgtgaatgttagcttaattgacaaaaaggactttgcatatgtgattagtgatcttttgagatggagagrttgttttagattatctggatgggcccaataatcacaatggtccttgtrtgaggggtgcaggaggagccagagtcagaggaggaggcagtgtgatgactgaggcagagattaaagtgatgtgatttgaagatggaggaggggaccacaagctagggactacaggcggccaccagacgctgaagatggtaaggacatgagttctcccctcagagcctccaaaagaaaacagtcctgctgacaccttgactctagaccagtgaaagtggctttgggcttctgacctccagaactgtaacagaaaaatawtgtgttgttttaagccactaaatttgtggtaatatgttacagcagccccaggaactgaatacaagctccttccctactgactgtggctacctctctctggatttgagctattcacacccctcctggggatgtatggagtgggaaaaacttgcccatatcatttgtcacatattgcattctctcagcaaatttacagggacttcaccaaaggattccactctcttgctaaactgaccttctcgatttctgatatttctgtcttcccctctccttagttatcctcctggattccaaagcctcccaggccgagctgggctggactgcactgccaagtaatggggtaagtgcacaagtgtccctccctgtcccagggatcctctggtggtccaggacacagtctcctcagctcctcatgtttacatcagacaaaagtgctcctcagagtgtgtggtctccagcagccctggcttcaagccagagtggcctgttagaaaacattgagtcttcagccagttagacagtcaaaaaaaaaaaaaaaagtgaataagtgaggagagaactggctgtctaggaacagaaaygtggcatctggatggagctaatacaggacagtggcttgcacatagtagtagatcctccaagcaatgttgttgattgattgacacagcaagcaagactgggagtcctaaaagaggcttggagacttggggtaggggaggatgatgtgggctgtaacagcagcttggtggagtgcaaagggcactggtcagagagtcaggaractacaggcaccattcctagctccaccactaacttgatgtgcatacctggtcagatcgctctccctctggagcctcagtttccccatctataaaaataaggattgggatcatttgtttccaaagtttctcccagcgctgcatcttacaatttccggggtgtgcatggtgcatgagagagaaagcaggagtcactgctagcgctccacctcctggaagcactttggctctgggctgcccacccctttactcttgtccccagtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacmtsggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccamgttcccagccaccgcagccgagrgcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacwtctgcgaaggtatccagttggctgggggccgtggggtgggagtgtagagcgtaggtggcaattgagagagagtgtgccctagaggaaagaggcgggtgtggggtcggggggcggtggagaagccttggactctggagcccaaggagagccctgaagtcttgtggagtttccagtgagtccagtcagggccaatgagtgaacttactagatgaaattgactggctaaggaggcattagggatctatatcttaggcaccttgcacaggccttctcgtttatttattttcatggcaataaaggaagtcattgtttttttttttttttaaataaggagtctctcttgctctgttgcccaggctggagtgcactggcttgatcttggctaactgcaacttccacctcctgggttcaagcaattctcctgcctcagcctcctgagtagctgggattataggcgtgcaccaccatgcccagctaatttttgtatttttagtagagayggggtttcaccatgttggccaggctggtctcaaactcctgacctcaagtgatccacctacctaggccttccagagtgctgggattataggcgtgagccaccgtgcctggcctaaaggaagtcattcttatctctatttcacagatgaagaaacagagcctcagagagattagtacctcacttgcaaagttaggaaatggggagctaggatttgaattcaggcttgcccaactcacattctatgacatcatgaggtctcctcagtgcataaggaagaactctacagcagcccaatcttcaggctagtgggattggttgcattacagagaggaatctcccagtcacggaccaaatacttgcaagttagaggctggcaggggggatttttatgctggagagagggattgggaagttgcactagatgattacgaagatcacatcccactctctgaactacaatcactgtgctccctgggggagatccttcatgttgagggttttgctggsttctcaggctagtgggggcattaggaacagacctctcattctctctcttgcctgtggctttggatacagagggtgatgatggggttattaatgtgtgtacttaatatagaaagatcaaggtatgctttttctaaaccatgtccttttctgggtgccagggcaacagaaatgagtcagacatagtcctagctctcaagaagctcacagtctagatggagagatgcaaaaatttaaaaatcacaagagggtaatatatgctataacagrgggatacacagagtggtgggaggacaggggaggaagtgactaaatttgctctcattcctttgttcaatcatccatccaatatgaattgaggatgtgccagctgcatttattgagggcttattatatgtatatagatgaatgccaccatctcctccctgcggaaattgtaatttagagaaagactgggaggcatgaaccttcctgagctctccagatatagttaggatccacctcggtgctctccagcattcattgaaacctatttctgtacttaccccatggtatgcactgatctacttatgtgtgttttcaccactagattaagaacttctttttttttttttagaaatgggggtttgtctatgttgcctgggcttgcgtgtagcagctattcataggtatgatcatagtgcattacagcctggagttcttggtttcaagcattccttctgcctcagcctcctgagtaggtgggactatagggaccacaccctagattaggaacttcttgagctcaggcactgggtgttactagtgtcagcagccccagcattcataacaggataaggcatacggtaggtgttcagtgaaaatgcattgggtgaaaaagtggttactatagggtgtgaaacataaacagagagctaaggaagcatggaagggagaacctaattctaagcatggagaaggcttcccagagaaggtgagaaggttttttttycccaggcagcttagagcattctaagcttaggaattgcatgcagaaggatggaggcagaaggaacatagcatggctgggcctatgtaactaaatgtggttggagcagagggcatgtgggggtgtgggagtgaagtgatggggttggagaggagcaggtggaaatcatgaaaggccttgaatgttgggataaagagcttagactttatgctttaggccaatggggaggatctgaagcagggatctgacatgctcagatttgtattttcaaaatatcactcaagctgcaattgcaaagaaaggattgaagagggaaggattaggagccagaagatgaagaaggaagatggtgcaatagtgcaggagaaagagcacaagggctgaactaaggtagtggcagagatcattgagagatgaggatagatgggatcatgagttagcatccacagcacttagtgmccatgtgatacaggaggagaaaggagtcccctttgacttacatgctactggggattgaatggacagagggatcattcactagggtacagaacacaggacctggatagacacatatttatgatgtccacggtgcattccagtggaggtagctagaaagtgggtctggagctctgaaagacagagacagtacttgaacctgtgggtgtggttgggacagaccaggagaacgtgtggggtaagaagccaagagggccaacaatgaagactcatagaatagcaatacttaaggacaagtagaaaatacagagcccattaaaaaggctgagagggagtgatcagagtatggaggagaactaggagagtgtgatattatgacagccaagagagattgaaggtgtccaggaaggaatgccctacagagttgggaagcagtcaggtaagtcaagggttagaaagtgcccagttggtggccttggtgagagcaattgcagctgagtgatggacacagagaacaggttgcagtagattgagggataaaggaagttgaagagcttgagtcagggaatctagaagcctggatttgaattagaagaggaggtatctcgaggaggacattggattgagagaggatttttattatagatgggagagacttgtttgtatgcggaaggacaaagagccactgggataccaagtgtgtatatgggggggatccccatcccggtcccaggaggcaggagtattttattactgatgtgggctagaattgctgatgcattttgctaataaaaaagcaggccagattttagtcagttttattattgtttttacatactctatagtttgtgcccttattgcctgcacccaaaatgggccactttttactgcttcactaccaagaagggagatgactgatggaatgtagtatttgatgaggttaaagggagagatccagggtggagacagaggggctggccttcaacaggaggtggctcattccctcctctaggactggaagggaggaggagaggggagatggttgtggatgggggcatttgtgtattctgatgggcagatgttgagggaattatcaactgatggcttcccttctccctataaggtgggagggagggcatctgtacaaatggacagtaaggtccttgtctgttttattcattgttgtgtatctatagagcctacctagtagatgccaaaaaatatttgctgaatgaatggatcaggagtgagaggaggaggtttctctgggaaatgwgggagaaagagagagagagagaaagagactcaggaacccaaaccatgtctgatgagaacagaaaaaggccayttgtaatggcctcagctctgccttggggagtggggagctggggacaatgccaaggaaagcttcacaagggagatgttatttgaactggggtttggagaagtatagaagtttgccaggagaaaarggatataaggaattacagaacaagacccagaggtgtgaaaggatgagctcagtgtaccatggktagagtggytggcagtggggagctgttggaggacattaggaagggaagggaaatgattggatttgcatttagaaagttaaggccttccaagtgccttctgcagctaacacaagcttccctctaaaagtagatggataagtgggggaatagaacgaatatgttcttttcccctttttgtttctctttagtgaccttgacttttgttctccctcggttagccactagagaaattagtaaaagagctggggtttcctttgggggaaaaaatcagggcatataacaagtagctttaattctmtgctagggccaggtgcagtggctcacacctgtaatcccagcaatttgggaggctraggcaggaggattgcttgagccaggagttcaagatcagcctgggcaacacagggagatcccatctctccacacacaaaaaattagccaggcatggttgcacagcatgcctgtggttccagctacttgggagggctgaggtgggaggattgcttggccccaggaggcaggggctgtagtgagctatgattgtgccactgcactccagcctgggcaacagagcaagaccctgtcacaaagaaacaaacaaacaaaacaactyagtgggattgccttggagccaagggacccaagcagatatgttctctgaggctccatagggcacaatgagcccctgtgatggggtggcacaaggggcattacagacagcgaagctaatgggggctcatcctaagaagcactttctgccagcattgttcaacaaaggcagcctcagaagcgggtgaatgcctcatgataaagtatgtgacaaagactgtggctactgctggggaagctgccggaggaccaggccagtgggagctgagctagattatctctgaaggtctgaccttgaagrgagggaggggctggcagtcaggaatccctgaatctgctcttcagcacaaactccttctaagcagagcctctyacagcagagataccactgtggtcgctgatgggcccacccacctctaggacagcagccaccctcatacacttgtggggagggagcctccagcattcttcccctatttttgtgaaaccctgcgaacagatcatttatctgggctctcacttgctctcctatttcacaacagtggtgggcagggcatggttgttattcctatttgaccaatgctttttttgaggccagagaggcacaaggagtggcccagccaacactagaacccaagctttccaagtcccagcctgggtctctgctgcccaccagaccacggggatagttggcccatgctctgttctgcaggcagaggagacttctgaaggctcctgggctgccgagcccctccccagagttgtgctgcccagaactctgggcaagatggaccctctcaaacctatgccttccrgacagtggaaatcctagtcccctcccctcttctgccacacaggctgaaagttcctcctgagggctagtctgcaccctttctgttgtactgcgtcttcttggagctggagagcagccagctaaactagaggagagggccagggaacaaggtgaggaccacccaagttctgagaggtagggccaggaaccamctggcccagctggtgagaaatttttttaaagtgggtgtttagcarttaccacttaaggcctgtgggggaggaacagtaattactatcattattgtgaaaatgtggttggtactgggctaggtggtttacatgttttatctcaatcctccaacaacctttttgaggtaggtattcaacacaaggctcagaggggtcaactgatgtgctcaaggccacacagcaaataagtggggtgactcagctacaaacccaggttgttcagatagaaacacttgtgatcttaacaacctgtgttctgagaagtgagagaagcaaactgagtaggtgtcaagactggaaccaggtctgactcatggtccagggaacttttactggcccttytctctccacccacccccctccacctggctggctttacttccagttgggaatttatgacacactcactcacatgatggtggtgtgagggtgtgtgtgtgtgtgtgcatgtatgcttgtgtgtctgtccctgcrtaactgtggaacagctcttggggcacctctcctcccctctctttctcacaccagcactgcagagtttgacttattttcttccagtggtcctgagggtggtgtgatgtgggcttgggttgggatcccacaggctgcgggagagtagctgtaggcaacttcacctctcctagccttagctccctcattttaaagaggataaagggtcgggcacagtggctcacgcctgcaattttggcactttgggagaccaagctgggcagatcacttgaggccaggagttcgagaccagcctggtcagcatggtgaaactccatctctactaaaaatacaaaaaaagtaactgggcatggtggtgcacacttgtaatcccagctactcaggaggctgaggcaggagaatcgcttaaacctgggaggtgggggttgcagtgagtggagatcccgccactgcactccagcctgggtgatagaaggagactcgaaaagaaaaaagaaaaaataaataaaataaaaagaggataaagtatataacctcacaggtggttgtgaggattcaatgaattaatagacgtaatttaaaaaataataaatagagacggggtttggccatgttgtccaggctggtctccaactcctgggctcaagtgatcctccagctttggccttccaaagtgctgggattacaggcatgagccaccgcgcccggctgaaagtaaaatgtttcaaagttttccgaacacacagcgttttctaagggtaggtaatgggttgttcaggagtcactccacggggcagtgctgactggagtggctgagtcccctgactgtttttctatcgcaattggaggagataaacgctgccctaamcaggccagtcaggaaagcggggagaaactggaggagccccctcttctcaccagycatgccctgcagcctgtcccccagggttttacaaggtgtccccgcggcggcccctctgctcaccgtgcccagagcacagccgggccctggaaaacgcctccaccttctgcgtgtgccaggacagctatgcgcgctcacccaccgacccgccctcggcttcctgcacccgtgagtcccccctccaggctgcactgcggagggtggggggtgggagtggccaagaaggaaggcctgatccaggtggtggtgagggcagggtctccgcactggggcgcacgkgggcggatatggggrccagcgccccggaaggcggcgtacgggggagcggagcctggacgcgccctgggggccggggcctttgatgagaagaaccaggacaactgcgagagtccagacggaggatggggttaggatgcctggcagatcactgaggagagcgcccctccgctgccctctcctcaccctgcctaccctccagccgaaaggggggctcccgaccttcgcaccatcggttcggtccccatgctsccatcctcggttcctcactaacctcctcccaaatcctcaccaactgccccgccactctcacattccgacctcccaagggcccccacgcccccgtctctgacccttcccggggcaagcccctcctcccgctcgcccctgctcccactcacccctgctcccgctcgcccctgctcccgcccgccctctgctcatccgccctcgacccctcactgactgaccatctctgtaccaatctccctgactgaaccccacgcccccattcctcccaccccagacccctcacaccttcctatcccccatgcccactggctcccacggcccattcccgctcatccatccctgttccttcaccggtcgtcccttctaccttcctccctgactgaccccatgccactgtctctcctgtcccccgtcccccctcatccaccaagtcccttgatgaacgccctggttccctcctccccgactgaccctcgcgcccctgcttctcctgcctcactgggggtggacaagaccccgcccccccctcgtgcatcccgcccctctcacgggcacccacgccccgccctgaccgccccgcccctgtgccgcctcagggccgccgtcggcgccgcgggacctgcagtacagcctgagccgctcgccgctggtgctgcgactgcgctggctgccgccggccgactcgggaggccgctcggacgtcacctactcgctgctgtgcctgcgctgcggccgcgagggcccggcgggcgcctgcgagccgtgcgggccgcgcgtggccttcctaccgcgccaggcagggctgcgggagcgagccgccacgctgctgcacctgcggcccggggcgcgctacaccgtgcgcgtggccgtgctcaacggcgtctcgggcccggcggccgccgccgggaaccacctacgcgcaggtcaccgtctccaccgggcccgggggtaaggccgtccgcgccccccaccccgaggccaccgcgcctgccgcccctgcgccctcttggggccgccccgtcggtcctgcgggagccccacccacccaccccagagaagccatcctctgtacacgcaccccgcccctctccgggacacaaagtcacccccccggacgccccagcgtcagtcgccctcccgagtgtgcgagagggactgaggatgcaggcgtccccttactactgggccagaggggaggcgcgcggttctgttgcgtctgcgggaagcacctgtgtgctcgcytttctcctggactccttgcacaaagcctctgtcccgctcacggctctgcagttggcctcgccgctgatttctcagggaaaaagaggtggaaagtcccttaatctcttmccttccctttaaaaaaatgtcagtaggaatccgaatttacttccttccctctgtctcgggaagccggatccggccctgtgtcccttacctccaaccctcggcctctgcatggttttgctgcatctggccacctcctttcctggtcccgggaaagggcaaggaagcttgtagagttaggctgtaggggcgatggaacacaccagccaatacatctctgagtctggacatgaggtgaataagtgaagacctacaaccttttcacaccacaccttcattcctgagagtttcttttgattcgcttctcagctggggtggaccttcaagtaatgcttgtattctttgcaagaaagataagcgagtggtatggtttctgactcccttcctaatcgagcctatagggtcggcctgtcaccctgcatccctgctttctgtgatcccrcttctgtctttggcagtggtgttgccaagaagtctgaggctagggttattttcattcttttctacttaacttggacatatgacatgtacacgtatgcacacggatgttagaataattctttaacctgcttaacctactgttgataataattttttttttttttgagacagagtcttgctctgtcaccaggctggagtgcagtggcgcgatcttgattcactgcaacctctgcctcccgagttcaagtgattctcctgccttagcctcccgagtagctgggactacaggtgcatgccaccacgcccagctaatttttgtattttttagtagagacggggtttcaccatgttggccaggatggtctccaactctcaacctcatgatctgctggcctcaggcttccaaagtgctgggattacagacgtgagccactgcrcgcctagccagactttctttttttttttttgaaatggagttttgctcgtcacccaggctggagtgtggtggtgtgatcacagttcatggcaacctctgcctcctgggttcaagtgattctcctgcctcagcctcccgagtagctgggattacaggtgcgcaccaccacacccagctaagttttgtatttttagtagagatggggtckcmccatattggccaggctggtgtcaaactcctgacctcaagtcatctacccgccttggcctcccaaagtgctgggattacaggcatgagccmcctcatgccaggctgaaaataatcatttaaccaatatggatttcttttttttttttctttttctttttctttctttctttcttttttttttttttttttgagaggagtctcgctctgttgcccaggctggagtgcagtggcgatcttggctcactacaagctccgcgtctggggttcacgccattctcctgcctcagcctcctgagtaactgggactacaggggcatgcagccacacccggctaattttttgtatttttagtaragacagggtttcaccatgttagccaggatggtctcgatctcctgagctcgkgatctgtcctccttggcctcccaaagtgctgggattacaggcgtgagccactgcgcccggctaccaatatggatttcttttgattgagtaaaccttttgatttgcacaacttttttttttcccgggaaaagttttcttcaggccgggaacagtggctcatgcccttagtctgagcactttgggagcctgaggccaggagcaatatagtgagaccctgtctctacaaaaaattttaaaaattasccaggcatggtgatgtgtgcctgtagtaccaggtgctcaggagggtgaaggaggaggatcagttgagcccaggagtttgaggctgcagcgagtgataattgtgccactgcactccagcctgggtgacagagccagactatgtctcttaaaaaaaaaaaaaaagttttattcagccactgctttgactagaacttctgatagctcaaatatatctcttaaaaatatctctaagccttaggttttacattcattttctgattctcaaatcttgtcacttcacttcccttatccttttgagctcttaatccatttccactgccttttggagattttccagcttgtctgggtttctggaacagtactgttttttattgtctctattgtgatttaacatttgctattgcatttacatctttaaaaattctttttttccatctttctttcatgtcagatgggtattttgccaacgtgaaaaggttcgggggtgacacatctcacatacgagtgtgaatccccaatcatcacacttgcaaactacaaaaggatcacatttttaaaaattcagtatagaagaagaaaaaacccataatcttattacatagataaaaacaactattaatatcttagagtatatacgtccagaaaatttttcctgtctatcttgatctctgtattcatatttgtaactatctacctataaaatcccttttgttttaatacagtcatgcaccatataaagacattttggtcaacaatggatggcatatatgatggtgatcctgtaagattataacggagctgaaagactcctgtcacttagtactttctgttacagttgcctgtagtattcagtacagtcacatgctgtcacccaggctgtacaggttgtagcctaggcgtgtcataggctatgctgtctaggtttgtgtaagtacactctgatgtttgtataacaatgaaatcacctaacaacgcatttctgagaacatcttcccatcatttagcaatgcatgatggtatatgtaatactaacttttatctggcattttacattaacaatctttttttttttttgagacggagtcttgctctatcacccaggctggaatgcaatggctcagtcttggctcactgcaacctcygcctcctgggttgaagcgactctcctgcctcagcctcctgagtagctggtattacaggcacacaccaccacawccggctaatttttgtatttttagtagagccccgcgtttcgccatgttggccaggctggtctcgaactcttgacgtcaggtgatccacccgcctcagcctcccaaagtgctgggattacaggcgtgagccaccgtgcacggccttatgttaacaatcttaactgttttgacacagatagatttagaagccatgttaaggaaatactcttctatttccattttctcaataaaaatactaagcttccactgatctagtgctgctgtatttggcactgtgcaatatgattttctacattaattcattgaaacggggctgggcacagtggctcacgcctgtaannnnnnnnnnnnnnnnnnnnccatgcccataatcccagcactttgggaggctgaggcaaatggatcacttgagctcaggagctcaagaccagccttcgcaacatggtgaaacctcatctccaccaaaaaaagaaaagtactaaaattagctgggcatgatggcatccgcctggagtcccagctacttaggagattgaggtgtgaagatcactcaagtccaggaggcaraggttgcagtgagctgtgatcatgccactgaactccagcctgggtgacrgaatgagaccttgtctcaaaaaataaaaaataaaaaatttaaaaaaattaaaaaaaaccccaaaacaaaaatccaatctgggctggccatggtggttctcccctataatcccagtgctctgggaggctgaggcagaaggatttcttgaggccagcaattcgagagcagcctggacaacatagcaagaccctgactctacaaaattttttaaaaaaattagccaggtacagtggcacatgcctgtagtcctagctattttagaggctaaggtgggaggattgcttgagcccaaaaaaagggggaagggaaaggaaaggaaaaaaaaagttactcagctaggcgtggtggctcacgcctgtaatcccagcactttgggaggccgaggcaggtggatcgtttgaggtcaggagtttgagccagcctggccaacatggtgaaaccccgtctctactaaaaataaaaaaaattagccaggcgtggtggtgcacacctgtaatcctagctactggggaggctgaggcaggagaatctcttgaaccctggaggtggaggttgcagtgagctgagatcgtgccactgcactccagcctgggtgacagagcaagactccacctcaaaaaaaaaaaaaaaaaaaaaagatgaaaagaaaggaaactcatcttagattggttttggaacccaggtctgtctgacctcaaagccctgtgcctttaatccctaggccatataatgcttcattgaactttttctaaaaatcagaaatgratgttaattttataaaatgcttattaagcattttcaatatgaccaaattttttcctttttgacctgtcggtatgatgaattctattaatggatatttcagtgtgaactctctgcactcctggattataccctactagatatattattctttggatgttttgctgagttcatttgcttatattttaagatttttcccatctacatttctaagagagattagtgttttgtaatgtgttctttgtcaagttttggcactatggggatgctggctttggtaaaggtatctggaaaaatttcttctttttctctgctctgggacagttttaacaacacatttacatattctttgaaggcataaaaaactgcctgggaaactttctgggttctatgccatttttggagagaaagttttatttatttgtttatttatttatttgagatggagtctctgtcgcccaggctggaatgcaatggcaccatctcagctcactgcaacctctacctcccaggttccagtgattctgctgcctcagcctcccaagtaactgggattataggcaaccaccaccacgcccagctaatttttgtatttttagtaaacatgggatttcaccacgttgatcaggctggtcttgaactcctgacctcagatgatctgcctgccttggcttcccaaagtgctgggattacaggcgtgaggcactgcacctggtggtttgatatttttaatctttactgtaacgtcttgatcagttttataaatttgtgctttcctmgaaaatattttggtgttctttttctaatttattattagaaatgtatatacatttcctcagtacctggagttaacttcactttctctttcttcctgttgtatgcttgtgatttctgtcttttttcttaattatccttgccagaagttaattttactggttatgacacagaatcagctcttgaacctatcaattccattgttctttactttcgtcacttattttatgatttattattattattatttttgagatggagtctcactctgttgcccaggctggagtgcagtggcaccatctcagctcattgcaacctctggctcccaggttccagtgattctgctgcctcagcctcccaagtagctgtgattacaggtgcacgtcagcatgcccggctatattttatgattttatctttattaataccactctcctgctttcctgaagttttttttttttttttttgagacagtttcactctgcctgtcacacatgctggagtgcagtggcatgatcttggctcactgcaacctctgcctcctgagttcaagcgattctcctgcctcagcctcccaagtagctgagattacaggtgcacaccactacgcctggctaatgttgtgttttttgtagagatgggggtctcactatgttgcccaaacttgtcttgaactcctggactcaagcaatctacctgccttggcctcccaaagttttgggattacaggtgtgagccaccccacccaacctctgaagtctttttctaggcaagttcagtgcttagttattttttgtttaaattttttaaagctatgagttttcctctgaatatagctttgtcacttccaatacatttgatacatgatattatcacattgttagtattataaggtttttttaggtataattcatgtaacataaaattcacccttttgaagtatacggttcagtgatttttcatatatccgcatagttgtgcaacaagtgctatctaattctaaaacatttcatcaccctgaaaggaaacccattagtcactcaccattccatccacctcctctagctcttggtaacaactaggtctttctgtttctatggatttgcctcttcttggcatctcaatacatggaattatacaatatgtgaacttgcatgtctggcttctctcacttagcataatggcttcaagtttcatccatattgtagcacgtatcagtacttcattcctttttatggctgaatgacattccattgcatggatagaccacaattttgcttatccattcatcagttgatagacattgggctgtttccacattttggctattatgaataatactattatgaatattaatgtattcataatacattaatgaatatatgtttttgcataaacatatattttcagttttcatggctatatacctaggagtagaattgctaagtcatatggttatggactgaattatgttacctccagattcatgtgttaaaaccctaaaccccaatgtgactatatttggagagagtctctttaaggaggtaattaaggttaaatgagatayaagggtgggccctaatccattaggactggtatctctataagaaaagggagagacactacccggtgtggtggctcacgcctgtaatcccaggactttgggaggccgaagtgggtggatcacctgaggtcaggagttcgagaccagcctcaacatggagaaaccccatctctactaaaaatacaagattagctgggcatggtggtgcatgcctgtaatcccagctactcgggaggctgaggtaggagaattgcttgaacctgggaggtggaggttgcggtaaaccgaggtcgtgccattgcrttccaacatgggcaacaagagcgaaactccatctcaaaaaaaaaaaaaaaagaaaagaaaagaaawgggagagacaccacagctcactcactctttgtccatatgtgcacagaggaaaggccacgtgagaatacagtgggaaggtggctggtcaggaaaacagctcttaccggattacagatctgctgacctcttgacctgggacttctagcctccagaagtgtgagaaaataaatttttgttatgaaagccaaaggtggcttttgttaggaaagccacctttgttatttatttatgtattttttgagacagtcttcctctgtcacccaggctggagtgcagtggtgcgatctcagctcactgcaacctccgcttcccaggttcaagcaattctcaagcctcagcttgccaagtagctgggattataggtgcrtgccaccacgcctggctaatatttgtattttttagcagagacagggtttccccatattggccaggttggtttcaaactcctggcctcaggtgatccacctaccttggccacccaaaatgctgagattacaggtatgagccaccatgcctggcttgaaagccacctttgttattaaaggtctgtggtytcttkttatggtaacctgagctgactaatacatataataactttttaactttttgaggaattaycaactttttcaaagcagctctaccattttgcattcctacctgcaaagtacaagggtccaagtttctctgcctcctcaccaatacttgttattgtttgtcttttaaacagtagccatcctagcagatgtgaggtaatatctcattgtggctttgatttgcatttccctaataactaatgatattgaacatcttttcctgtgcagggttttctttttgtcattaagttatattataactatagatatgtattacagacactagacccttgtgttcatttcccagggttgctctaacaaggtgccaaaaaactggctggcctaaaacaaatgtattgcaaaatcaaggtgtcgtcagagccacgctgcctctgatgattctagaggaggacccttccctgcctttcagcttcttatgtttcctggcaatccttggtgttccttggctcgcagacgcatcactctagtcacatggctgtcttctccctgtgtcttcacatcatcatctctctaggtgtttttctctgtgttyaaattcttcttttcatgaagatgccagtcatattggattagggcccacmctaatgacctcattttaacttgattacctctgtaaaaataagatcacattctgagatgggaagtggtggttgggacttcaacatatcttttttggagacacaatttaacccatacaaaccttgtcagatacatgatttgtgaatattttctcccactctgtggtttggctttcactttattgagaatagcctttcaatcacaaaagcttttagtttcttttttttttttccccaagatggagtcttgctctgttgcccagggtggmgtacagtggtgcaatcttggctcactgcaacctctacctcctgggttcaagcgattctcctgcctcagcctccagagtagctgggactacaggtgcacaccaccacatccagctatttttttttttttagatgggctggagtgcagtggcatgatctctgctcactgcaacctgtgcctcctgggttcaartggttctcctgcctcagcctcccgagtagctgggattacaggcacacactgacgcacccagctaatttttttttttttttgtatttttagttgagacagttttaccatgttggccaggctggtctcgaactcctgacctcgtgatccacccgcctcagcctcccaaagggctgggwttacaggagtgaaccactgtgcccggccaaaagcttttaattttgatgaagtcaaatttatttatttcttctttggttgcttgtgcttttggtgtcatcgctaagaaaccattgcttagtccaaggttaacatttctgtgttttcttttagtgttgtagttttgaatcaaattattttagaggatgtgcttttatttccagatgacttgcttttattttgtttgtctttacgttgctgattgtagtgcttcatggaggtttgtacgtggtaaaaatttttaaactatttcatggctactttaaaacaatgtgcactattttatggtgtagttctttctctctctgtctttatatttctatatctatctatatatacacagatgttcctcaacttaatgacgggcttatgtcccattgggcttattataagttgaaaatattataagtcaaaaatgcatttaatgcacctagcctgccagatatcataccttagcctagcctactttaaacatgcccagaacacttacattagcctacaggtgggcraaatcacctattttacaatgagtattttacactgagtatctcatgtaatttattgaacactgtactgaaagtgcaaaaatagaatggttgtattgcttttacaccatggtaaaacaatcatcagttaaaccatcacgagttattattcagttgyrgttccttcttattttttacttgatgttccaaagactgagaggggttcattttgcattctgtttgtgattttgttaaaattccttgtatttgtaatgaattttattttaaatatttcaattttgctgatgcacttttagtttcttcacccagcccttctcagtttctccatttttatctcatctcgtttctttttcttctccacctgttttctccttatgaccttctgtacmtagttggtggaggctgtgttttctttcttcttaaagtgccagagcgttttacttactctctatcatattaaatcacttttcaagatctacttctcctgagtcttcagartaatgttcctattctcttattctgaaatattttttcatatacccaatttctggtattttctgtttacttgttcttgagtaaggaaatagctggtgtttgtcaacaacaacaaaaaagatgcgtgaattgccctttgaattagttatgaggttttcagctgcaagtaacaataaatctcagtctaactgattttattttattattattattatattattattattagagacaaggtcttrctctgtcactcaggctggagtgcagtggcatgatcataggctcactgtaacctcaaaytcctggggtcaggtgatcctcccgcctgagcctcccaagtggctaggactgcaggcatgccaacatgcctagctaacttttttttctttttaaattgttttgtagagacggagtattgctatgttgcccaggctggtctctaactcctggcctcaagcaagacccccatctatgcctctcaaagctcatcacataggctggttccctcatggtagcaaggtggctgcagcagctccagacatcacatccttaccattcrgaggcagaaaaagaactgtttcttccttgcaggtatctttttaaaagcaagaaacttttctctgaatcccctgtccccagctaacttcttttgttggccagaactggattgtaagcccaaccctaaaccattcactggcaaagggaatgagtgcacacaaatgtcttagaacarccagaagttacccaagtcacctatggggagacagtagactatgaaccaaaaattcagctcagctagcaggaaagggggacaaggctgttgactaggtttccagtactatctgctgtaactttggccccacttgggtgctggctgattcccatcccaaatctacagctggagagcmggtgcttggtgttagtttttagctccactagcaggatttatcaggctttcatctaattatctcttcggagctgagatggaaccatcttctacctctctatcctggccatctgatgctttccacaaatgtagctcaaaaatggacatttctagcctccttttccatctctgccccatctgtattcgcaaggaactttgccacctcctagaatgcttcatcactcctctcgcctttgtgctcaggccttttctgggagctgccrtctcaaagtgaattttggctgagaagcgcccccgggggatagggaagagcactcttcctcgaaagcagctctgcagtagagtgctggctgtgcattgtccacttgacaaagacttggctttttttttttttttaaagggtcagacactgaagggaggaataaaggatttttttgagttatttttagaatgggaggcaatgccactctgtgggcagtgtagcctaggggttcattacaattgcacttttkgatctagtcccactgccttgatcataagtagaaatgtgccactctactctccagcccccattctggcgatcagctgtcaagactagtttatggtgatggtgtaggttttcaactcttactgtgtctttatgttttaattggaatttgggaaagacatggagtggaggctgctagatatatataccatttaagactagaagccacatccacgcacttgtcagagcctgagccacctactccgtttccactttcttgctttattactatctgatcggtactttcctcaatcccctgaaggcaccgggaacgtccactttatgaaagccagtgggaagtttgaatcatcatcttactctgttgtctcctctcagcgtaagacatggcccagcgccagctcctcttgctggaatgctggtgctgagcactcgctcagtccctcataacacattacttcataaaattcccacagcaagcctaggaggtgtcatcattgttctcattttacacacggggaaacygaggctcagggagtaagatcacttgcttgtggaccaatagtgggctaaccactggaaaagtcaggagggaaccttcctaaatgttctcttccctgggcttccatcaccttgcccacccttggtcttcctcctgcctctctggctcctccttgtcaagcttctcttcctttgcctgtttcttaattgttggcgtgtctcaggcttattccctaaaagcttttcctcttctctttttatgcgttttccctggacagtttcatcccttcaccttatcatggctcctgcatctccatttttctcccagacaccttttctgagccctggaaccatttctcccactgccctcctggcatcttctcttggaaacccctttgccgaacactaaccccaggccttattatctcccgtatatgtgtgtatgtgtgtgtatgctgctgttcatctgacatcatccagactggcggttctcaaacttgtctgcacgctggaatcaccaagaaacttaaaaaataaagcaactggctgggcacggtggctcacgcccgtaatcccagcactttgggaggccggggtgggcggatcatgaggtcaggagatggagaccatcctggctaacatggtgaaaccccgtctctactaaaaatacaaaaaattagcyrggcgtggtggcgggcacctgtagtcccagctactcgggaggctgaggcaggagaatggcgtgaacctgggaagtggagcttgcagtgagccgagatcccgcccctgctctccagcctgggtgacagagtgagactctgtctcaaaaaataaacaaataaataaataartaataaaataaaataaaagcaactaatccctgagctccagcctacagagatgatgatttgtttgctctgggttgtgacctgggcaacattttttttactgtaaaaaacacataaaatgtatcatcttaacccatttcacatgtatagtacagtaatgttaactagatacgttgtccaaaggatataatttttttcctttatttttatttatttattttttttgagactgggtcttgctgtattgcttaggctggagtgcagtggcagccttgaccttctggtcttgggcaakcctcctgtctcagcctcccacgtgtctgggaccacaggtgtgtgacaccatgcccagctaattgtttgattttttgtagagacagggtctcactttgttgtccaggctggtgttgaactcctgggctcaagcgatcctcccaccctggccctcccaaagtgctgagattacaggcatgaactccaatacctggggtgtagaactttttcatcttgcaaagctgaaattctgtatccagtcaacaactcccctttacccccaccaccctcccctggcaactaccattctacttccttttttttttttttttttttttgagacagggtctcactctatcaaccaggctagagggcactggtgtaatcttggctcactgcaacctccacttcctgggttcaagtgattctcctgcctcagcctcccaagtagctgagattataggcacacaccaccaggcctggttaatttctgtaattttagtagagacagggtttcactacattagccaggctggtcttgaattcctggcctcaagtgatctactggccttggcctaccaaagtgtactgggtttacaggtgtgagtcactgagattataagcatgagtcactgcacctggcctactattctactttctgtttcaaagagtttgactactttagatacctcacataagtggaatcatgcagtatttgtctttttgtgacgaattgtttcacttagcatagtgtcttcgagkttcattcatattgtagcatataacagaattttcttctttttaaggactaatatcctgttgtatgtttacaccatatattcttttttcttttcttttttttaactcttttttattattatactttaagttctagggtacatgtacacagcgtgcaggtttgttacataggtatacaagtgccatgttggtttgttgcacccatcaactcgtcgtttacattaggtatttctcctactgctatccctccccctaccctccaccccgcgacaggccccggtgtgtgatgttccctgccctgtgtccaagtgatctcattgtaaaactcccacctatgagtgagaacatgcggtgtttggttttctgtccttgtgacagtttgcttagaatgatggtttccagcttcatccatgtccctgcaaaggacatgaactcatcctttttttatggctgcatagtattccatggagtatacaccatattttctttatccatttatccacttatggacatttaggttgcttccacctcttggctgttgtgaataatgctgcaatgaacatgggtgagcagtatctcttcaagacctgatttcagttcctttggatatatgcccagaaacaggattgctggatcatatagtaattataattttttaaggaacctccatattgttttccatagcagctgcaccaatttacattcctacacaatggtgtacaagggttccaattttttcatgtccttgccaacacttgttatgtcccatatttttggtagtggtcatcctaaagggtgtgaggtgatatctcattgtgattttgattttgatttccctgatgattaatgatattaagcatcttttcatgtgcttcttggccttttgtatatctttttttttgagacagagtctcactctgttgcccasgctggagtgcagtggtgcgatctcagctcactgcaacctctgcctcccaggttcaaacaattcttgtgcctcagcctctggagtagctgggattacagatgcatgccaccacgcccagctaacttttgtatttttagtacagacggggcttcaccatgttggccaggctggtctcaatctcttgacttcaggtgatctgccccctcggcctctccaagtgctgggattacaggcaagagccaccgcgcycagcctatatatcttttttgaagaaatgtctactcaagctggtctgagtgcagtattgtttacaactaactgatcacaaccagttatagatttctttgttcatctccactcccactgcctcgcttgatagcaaaaaaaaaaaaaaaaaaaaaaaaaaagcctacagttatttggtctttgttgttgagttctagacattctttatacattctggatattaaccccttagataaatggttagcaagcattttctcccatttcaaagactgctttttcactctgattattgttgcctttgccctgcagaagttttaaagtttgatgtagtctcatttgtctattttcgtttttgctgcctgtgcttttggtgtcatatccaagaaatcattgctgaatccagtgtcatgaatcttttcccctgtgttttcttctaggagttttatcatttcagatcctacatttaggtctttaatccactttgagttcattttttgcmtatgattttaggtgagggtccaacttcattcatttgcaggtggatatccacttttctcagtgccatttggtgaagagactatcctttctgcatagcataaccttggtacccttgtgggagatcatttgaccatacatggagaggagttatttctgggctctgtattctgtttcattggtctatatgtctgtaccatattgctttgattactgtagctttgaaatatgttttgaagtaaggaagtgtgaggactctaccttttgtgtgtgagtgtgtgtgtgtgtaggttttgttgttggttggtttttgtaaatgatggagtctcactgtgttgcccaggctggtctcaaaatgctggcctcaagtgattctctcaccttggcctctcaaagtgctgggattacaggtgtgagccactgcctctggcccacctttatttttccttcccatgattgtgttgactattcatggtccttttagattccatatgaattttaggatgttttttctatttctgcaaaaaatgcctgggattttgataggattrcattaaatctgtagatcacttttggtagtagagacattttaacartattaagtgttctattccatgaacacaggatgcctttccaattatttgtgttttatttcatttctttcagcaatattttatagttttctgtataaaagtctttcatccctttggttaagtttatgtctaagtattttattatttttgatgctatcgtaagtgggattgttttcctaatttcctttttgaattgttcattgtgtataagaacacaacaaatttttgtgcattggttttgtattttgcaactttgctgtattttgtttattaattctaaattttattttatttttttgagatggagtcttgctctgttgcccaggttggagtgcagtggcgcgatctcggctcactgtaacctctgcctcccaggttcaagtgattcccctgcctcagcctcccaagtagctgggactacaggcgcgcaccaccatgcccaactcatttttgtatttttagtagagacggggtttcaccatgttggccaggatggtctcaatctctttttttttttttttttttttttgagacagaattttgcttttgttgcccaggctggagtgcaatggcacgayctcagctcactgcaacctccacctcccgggttcaactgatcttcttcctcagcctcccaagtagctgggattacaggcatgtaccaccatgcctggctaattttgcatttctttakyagagacagggtttcaccatttgatcaggctggtctcgaactcctggcctcaagtggtccacctgcctcgacctgacgtcaagtgatccacctgcccggctggtcttgatctcttgacctcatgaaccacctgcctcagcctccgaatgtgctgggattataggcgtgagccaccacgcctggcctaacaattttgtgtgtggaatctttagggttttctacatataagatcatgtcatctgtaaacagagataaatttcctgcttcttttccagtttggatgccttttatttctttttcttgcctaactgctctggctagaacttctggtattatgatgaataaaagtgatgacagcagacatcttacctttttcctgatgttggagggaaggcttccagtctttcaccattgggtatgatgctcactgtaggcttttcatatatggcctttattcttttgggataatttccttctatttctagtttgttgagtgtattacctcttgaccagaccattggaatcgttaagaagcaggtccttctgcctctaaatgctctcttatgtctccaagctgcagcaagtatagaaagagcctggaggattagagccraccaccatgagagaagcygggctgwaaggggtgggcaagcagcagaaggcctaatgcttttccctctatgggacaatgaagaaaagggctgtgggggcagaggtgcttctttcctctggtcccacagactcctctcctttggccatgcctctcagtcagttccctagccccgcccacagcccgttagaccacgccccaggcctctctagtccggtcccacagccccgcacgcygcaccctcttcsccgcacccccagccctgccgtgaggtgggtcaaggtggagaatcccacgtaacttactttcagcgccctgggaggaggatgagatccgcagggaccgagtggaaccccagagcgtgtccctgtcgtggcgggagcccatccctgccggagcccctggggccaatgacacggagtacgagatccgatactacgagaaggtgagtgcgtgtctgggagggacctggagcctgccccgcacctgtcccgcagggcttctggttcttcaggccatcctcccagcaaaagccctcgttactccctttgtaaacataaccacccgtctcctaggggccccaggctcgagtctccccctcctcccccggactcctgctcttcctccctccgctcaggtctatctccaacaccaaccatctccattgtccccatgtcacctagtgtttcggttgacaaagagctttctctggggcccggtccagattttgtgtggctgaatcttatacgtatcatttgtagagcccttttaaagaaaaaggacacagaaagatcatatcatttctaattttacaaaagtgcctgaccatggagcacattgctgggtgtggtggtgtgctggtagatatttaacagccagctttccagaacaataaatgtatgagttattataattccagtcatataaaaaagtgtagcacagcatttacagtgataataaaatatgttcagaactcttgattgtgaactccatatggccaattgatccccataggatacttgtgctgatttttgctgacctcttgtatccattgtcaatctgtggttgcagcttagctgtgatgtaacaaatggagtcacatcccaatctgctcttttccccgtaagtttattacctttattatttatttatttatttatttattttgagacagagtttcattcttgtcacccaggctggagtgcagtgacatgatctcggctcactgcaacctccgtctcccaggttcaagtgattctcctgcttcagcctcccaagtagctgggattacaggcatgcacaactacacmcagctcatttttgtatttttagtagagacgaggtttcatcgtgttggccaggctggtctatatctcctgacctcaggtgatccacccgccttagcctcccaaagtgctgggattactggtgtgagccactgcacctggccaatttattatctttaaatctgatatgcaaactactgttaaactgtttctcaccttggtgcaaattatattcactgaagtgaaacctctttcagcttctacatgtgtcagaacttcactcactcctcaatgacatgagggactcctttgctgaaaatagtttttgaatactggaagtctgttgagacctgtgagtgttggggatgagtrggaaggaggagagagtcctgagtcactgctgggtgtctgacctgggtaacccagagtctgaggtaccactgactgagatggagaagcactgaggtggaagggcaggcttggagcaaggtgatgaacctggttttgctcatctagcattcagggggcctctgggacacccaggtagacttgcaggtctgaagcttaagggagaggcctggcttggaaagggagagaaagagagagagagagagtgagagtgttgggggctctcagcatagagacagtagctgctgccaggggagaaattgggggagaggaatgagaaggggaatgtgtctgagaagagtggccaggacagagccctgaggaatgctgatgtttagggagagcagcaaaggacactgggaagcaggtgcttagaaaggactcactgaatggactttgaggatcagggtatagacaagagccccaaggttgagctgggtggatgctcccaggttgttgggcatgaaaaccctcaaaaagaggagcaagggccaggctcagtggctaccacctgtgattccagcactttgggaagctgagacgggaggacggcttgaggccaggagttcaagaccagcctgggcaacaaagtgagaccgccacctctacaaaaaagaaattagccaggcatggtggtgtgcgcctgtggtcccagcaacttgggatgctgaagcaggaagatcgcttgagcccaggaagtcgaggctgcagtgagcagtggttgcaccactgcactccagcctgggcaacagagcgagaccctgtctcaaaaaaacccaccaaaacccccaaaaacaacaaaaaagaaggaacaagtccgggcgtggtggtgcacgcctgtaatcccagcacttcgagaggccaaggcaggtggatcacctgaggtcaggagttcgagaccagcctggctaacatggcgaaacccagtctctattgaaaaaacaaaaattagccagacatggtggtgggtgcctgtaatcccagctactcaggaggctgaggcagggaraattgcttgaacccaggaggtggaggttgcagtgagccgagattgcaccacactgcattccagcctaggtgacacagcaagactctgcctcaaaaaaaaaaaaaaaaaaaaaaaaaaaaaaaaaaaaaaaaaaaagaacaagtataaaagggctatatttgaaaggcttcagtgtactctcatggagcctgctgagtagaagccttgctgggccactggacctgggcgggtgtctggcagctcccctytggagccacagtgctgctcatctcaacctctctctgcacaccagtccagcccatgatgcagaggggcttgcttacggcacgttgccaatgcccaggtaggcagccttgctccttcctcctctctgcccctagcctgccctaccttgtgggtcctgaagccactgcttctctgtctttcaatggattgttgagatgcctggaagagagattctgattggcccagcttgggtcaaagtccgtcccagttcctgaatgctatggtcagaaagctggagccaccgaatatcagtggggagaataactttctggggctgtggrtatggcagggcctctaataaggtgtgggcagggacgaaacgacgggaggagcatctctagtatgccattgtcaggtgtgttggggtggagcggggggcagcatgatgtcgagcaaaaaacacgggctctgcagggattcagagggtgcaccagccccttccttgatgtgaacctcacctaaaaaggagatggaaatgctgactccacagggctgttgtgaggctcacaggaggcaaagggtctcatgcagaagctggcactgagtaggcgctcatcagtgatggctccagctggggccttgggggagtctttacccctctgaactgggtttccttatctgtgaaacaaacaaacaagataatactttctgtcctctgagccttgcaggacagttgtgaaaaatcagacatcgaggaaaggaaaagccttgtgggccattgggggctttcatgtgtcagggctcattctctcattcygtcctttgaggcttcaggcctgcctagggcactggctcagcttagcctggatggacaggccctgrtggccctcatcctatcatsccccggaaggaggatctggtgtcttctctaaaatttctcttatgcagaggtggtgctattctcagctacaagtgccaccgagtgtgggtgggtgcttgtggtgaagacaggggctaaggatccaaggaaaagatccctgggaamccccaagatgattgaggttgggttttcgcactcagcccacattcacgtaagggcgcttctcctgcctccctgttcctgttcaccctttgttctcctagaacagtggatctggcgctggtgggcttcacttcttgatctctctccagggtcagagtgagcagacttactccatggtgaagacaggggcgcccacagtcaccgtcaccaacctgaagccggctacccgctacgtctttcagatccgggccrcttccccggggccatcctgggaggcccagagttttaaccccagcattgaagtacagaccctgggggagggtaagtagtgtgtgtgagtggacagggacctagacagagagaaccctgcacggggctgaggtagggagacaaatagagggggagagttatctggagttatctgtgcaatgaagggagcctgcagaacagtttaattaattacagcctaattaattaatgactttgaaatccactgactaatgcctgttcaccgacgtgaattagattgggaaactgtcctggaggagctcacaggagagggrtttgtgaacagctataacccatgtctcagctggatagagactcagtttggatagagacccaaacatgggacactgtccctttccccactaggccttagagcgtgatgctgacttcactgaaggttgatggacatgaaggggttgcattgcagtgataaacacaaaaataaggattgcggccaggcgcgatggctcacacctgtaatcccagcactttgggaggctgaggcaggtggatcacctgaggtcaggagttcgagaccagcctggccaacatggtgaaactccttctctactaaaaatacaaaaatcagccgggcgtggtggcgggcacctgtaatcccagctactcgggaggctgaggcacaagaatcacttaaaaccgggaggcagaggttgcagtgagccaagattatgccactacgttccagcctaggtcacagagtgagactctgtctcaaaaaaaaaagaaggattgtgtaacttaagtgggtaaatcacatggtatgcgaacgatatctcaataaagctgttaccaaaaccaaacaaaaactggaaattgaatatcctcatctgaaaacatctccggcttctccgcaatattgtgctttcctccctcctcctttacttccctcccctggttcctcttctccccacccactgcccaattccctgatgtgtgcacagcagtttagctgtcttgttgctttgcctgctgctaacctggtcctcaggatctcacctctatctgccctgagcagctcatgaaaatattttcctgaacaaaggcagttccccctaagaggcattctggyaccagctgtcaagataataattctttccaacctgctacatgactctaatccaagataggaagagctctgagtccaaagggaagtgaagataaaatgctgaaggggtctgagttctgggaaggaagaccacacttctcgcctgaatgcaaaaagtgtcagacctcggccaggtgctggaaagagaagattatagctggggatcatttgaatgtgtacagatgggcagggaggcatkctggggagaggaagctatctgaacaaaggcgggcaggtttggctggagtgggcgtagtgggggcaggagctggggaccgtcagtggagaagggctgatggtctccattcattgggtacctctcagatagtagagactgctgagatccccagtctcccttcttgtggccctggctatggttctcccaatctgcagagtgtggtttcccaygagctgtgtctccaaattgagatttttttttttttttgaggtagggtcttactgtgtcacccaggctggagtgtagtggcacaatcacagctccctgcagcctcaactttccaggcttaagtggtcctcccacctcagcttcccaagtagctgagaccacaggygcttgccaccatgaccagctaatatttttactttttgggggtctyactatgttgctcaggctggtttcgaactcctgggctcagrtgatccctccactyggcctgccaaagtgctgggatcacaggtttgagccactgccccccgccttccaaagcaggatctttttcttttttctttttttaaaaagagcgatggaatcttgctatgttgctcaggctggtctcgaactcctgggctcaaagcaattctcctgtcttggcctcccaaagtgttaggattacaggtgtgagccaccatgcccagccccaaatcaaggtcttggtgaacgcttatgcgtcaccactgtgctagttacctattgctatgtaatgagttgccccaacatctagcaggtgaaaacaacaaatatttataatcttatgtttccatggattggtaatataggtgcctctcagctaggtgccagtgacttagggtctcttccaaggctgccgtcaagttgtcctcaggggctgtgatcatctcggggcttagctgggggagagttcacctccctgctcagggtcttgctggctgctgctgaggcatgctgttccttgtcccatgggcctctccttagagctgctcaccacaaccactggattcttccagagactgtgagccagggagagggcacccaagacagaagccattcatcttgtttcctgatcttgggaatgacatcccaatactcttgccatattctgttcattagaaatgagtccagcctgtgctcatggggaatggataccaggaggtagggatgccatctcagagactgcccactgctggcatctttctccgtttctgtgtccacatggttgcctcatttcaaacagttcttggcaactctattcccctctatccccacccagaccctcagccctctttgcctctggaaccctgggctctgaaatgccctctctgactctagcatttttggcttctaactctcgtcttctgttcctcctcacttgctctgtgacatccgaaagactgctcactggatcctacctcatctcccagacttttagctcctcctggccccacacccatctctatccagcccctgcagatgatctcatcagaaatactccccaactctgccaaccctcattccctgggcaccttgctgcacccacctgctagtccccagacttggacctttctcctccctgtgtcccacgcggaagctgcctaaagaggtgtactttccaatctyagttcagtcttcagggccacttagtacttttcccattcctaatagttatgccaaaccttcasctctctcaagcacctcttctccatcctcactcccacctcagcagacaccctcattccttttcttcttaggcaggaactctctccactgctccctgtcacccacaggagaaagtttatactccttagcttagcgttcaaggccctccaggttctggctcccccagttccctccatcttcccaccctccagcttcctatttgccactctccgccttcatgcagtctgtttcccagacacaggggacgacttgccattttcagacccagtgtgtgcatcaaagcaccatcaaaaatccttccagtctccaggtccagttcagatggcacctttttttgtgaagccttcctcattggctttaggaagaaattattgtgcctctgctcagctctgctcatttctgtttcttttttcattctacagttaagatttttgtttctgtctcacccgtaggcccattcacccctctctcctcagtactaatgcaaaccaggcacataggttggatggatggatgggttgattggatagatcgatgaatagggctgagagcgagggtcctctaggctgatctcttggagaaatagttcaaagcagaagctttggaatcaggcagagacttttggagtgatgctcaaatcttaggttcaccactttttagccatgtgatcttgggcaaattatgtaatttctcaacctcagtttcctcagctgtaagatgaagatggtaataccttcctggattattgtgaagatgaaacaagacagtatagtgtaggcacatggcccagtgtcttgaatggagtaaggtgcagttaccgttagccctttttattattgttggtggatggtctggactgggggtagggagctcagagcagaggccattcctcctgcagagcaactttgagtccctcactgctcatctgaaaggcatagagggaggcctggccctgcctgtctggactcctgcctctctgagcaggagctgggctgctgtggaggtgttctgccctgagagcagaggaagctcttgggactccaggtgccactgtggtcagtgggactgccttggcgcctctgtggctgggaggcagtgccaagtgcagaggtgctatgggaatcctgctacagggtgaggacaggagtctgccctggggcttgcctaggagcctggtcctctgcctgcctcaacctcgtgattttcctcccagctgcctcagggtccagggaccagagccccgccattgtcgtcaccgtagtgaccatctyggccctcctcgtcctgggctccgtgatgagtgtgctggccatttggaggaggtaggtggctggccccagcctaggtgactcctggtgggtcatgtcccgtgcacattaatgtgtgctcacaggcatctctgcccactttgcacacacgcagatttgcacctgcaagcacactgctgtacaaatgtaggcatgcatcatcccggcccctccccccagctcaytgttcatgtggcagccagcactgcagctagctcagctgctctgggatgaaggggatttagcgccttractcattaaatgtcagaaggcatcactgaggaaggaatcaagctccggctgctccagtgtgattagaattctccggaggagctcagaggcccccagcccctgtccccgggcctcttgaggccctcgaacacaggaaaagggggaaaagacagaaatcttgtgtatgtatgtgtgtgggaggggcaggacagggagggcaattcataaagcagaaacctcccacccccagcagaaagaagcytgcaggagggtgagcagagaaaggggataggaggaagacatagagcttgagtatggttcagagaagattctagtccttttgcaggcagcagaggcctyctgccatgtatcctccccttctccccagggccacactctgctgcaggcagagtcgcccagatgggtcccaggctgggcgggctggggagccacatctcagcatcctgaaactgcctggcagctggaacgacaatgggcattcatttggcactggctaatttgcttggccttgaatgaggcactgaaagtgactgagtgggagagaacactgtctcgctagtctaggagccagctctgcctggaccaggcaaatcaggagggcaggacaagagtagggagttccttgctcgtggagcatgaagggtccatgtgctggacccgttggaaaagcagagatggacagatgccgagagcatctcatcctggctttgcactgagaggctctgagaggcagaaggaggaaagggagacaagcaagccaagagcccctcttccgggcagaggctctgcaggacaggagcgccccagggacaggtgcactacagaggcggagcaagccagcgcgggattccaaatccagctgctctgaaatggggagagtgagcccagtctagtgtggaggggtagagaggtgttctcctccagcatgcatgtcccagcctggtgggctgtctgcagcacctctcacaccgtcctgkgtgtagtacctgctctgcgccrtggtccctcacctccaatttccctcctctccagtccaccctagcttgcccacttctcaccagaccgtgtggtccagtggaagcctctctcctctcctcaccacgcaccctctttcgctcctccatccactcagccttcccsccttcatctccacccatctctcctggatgttgctcctcattcgtggaagtcctgtcaccaccctgggtgacttcagtagctgccagacagcctgtcccatcccttgcccctcggttcttggacttctcattcccaaggatcatctcttctgttcctcctggccatcctcctagaatgcttcacctcgttacttctttttttttttttttttttttttttgagatggagccttgctcttgtcacccagactgaggtgcagtggcatgatctcagctcagtgcagcctctgcctccccggttcaactgattcttttgcctcggcctcctgagtaactgggactacaggcccgtgccaccatatccagctaattttttgtatttttagtagagacggggttttgccattttggccaggctggtctcaaactcctgacctcaggtgatctacccacctcagcctcccaaagtgctgggattacaggtatgagccaccatgcctggcctcaccccaatacttaatccagttcccttcttggtctgcagacgccctgtctttgcagcttgctgtcttggccacaccagtcacacctgttctttagcctcatcactggcccctggactactcaccaccaaacctacaaacctgcctgcttctgcacccatcctcacccccttttctctagaggaggtgatcctcccagccaggatcagtccttccacctatggctgaaccccacccttttgccatcttgggagcccactattactcctagtgttcccctctgccccccataacagtgaacatgtgtggaggcttggtaagctgacatgctgctgtctggcaggcctatctttatcctgattttattaaagagaaaatggagccacccagtcccacagctaccgagcggagatgctgggaagcaggtccctgcagtcaggttccgagcccaggctgtcaacaccctgcggtggccgcttccccctgtgtgacagcctagctcctccttcccatctgtatctacatgtgatcatctctgttgtgaaaacttcggaaactcctcccttggtctctcatccttgtacctttatgtgatttctctctaccatcccctctactttctctgtccttggtccctgtgataccctgccccagtttccctctgctctccttctgttcctctggcgattcttttgtactgtccttggtgcttccttccgctagcctagatgttggggtttctcagacttattcctagtccctcttctcagactccatcctctccctgggccatgctcattgctcctgatttgtatctgcagagcaggcctctcttccaagctccagacacacacacacacgtcraacgcccgtcttatcttccctgcttatcccccaggcctgcaaactcagatgtctaaatgtgaactttttgtctcctcatcccagtaaatggcaccaccataaactgtgggcaacttctccctcttcctttctgccatccaacaacctctcagccctgtggcccctgtcaccttcatgtcactcgagtcctctgcctctctccatgcccatgttgaccccatagctagaaccactgccagctcctctcctgtggtgacacccgtggcagcttccactctgcaactggagctctttctaaagtagaaatcaaatcattgcactcctctgcttcaaccccacaggggctctcctctgctcccagaataaaagccaaagtctttatcttggccagcaaggccctgcccctaggggccycaagtaccggcctgtggctttgttgactgtgatgcagtcctttggcccgtggctgcctctgtctcaggaagcsctccacaatgaccttggatcaggtcaggcctgtctgtcccgtgtcccaacagtacagcacctttctcctttgccagcactggtgagtgggcttgtggctaactctccatgtttgttttcctgaccagaccagaagctgcccccgagtgctggatccgcttgccttattcacactttcacaaaaccgcatgcgggggcagctgggggcctgcagccaggatgtggattgggtgcctctggagttgcaataattttcaccatgtgaaagtagctagggatggtggtggtggtgacggtttggtctagggctacggttgtatctgtgccatggggaggtcrtcaaaccacagagaagcttttaaaccagctggacaagaagttccctcccccagggcacaggcctkgtcttttgaagrgacaaagaggtgctgccctcagtgctctgtaatgggaagggccggggtggcctggctgaaagaatgaccctgaactccctgccaggccctgcagctatggcaaaggaggaggggatgcccatgatgaagaggagctgtatttccactgtgagttggctgggcctggctggggaggggcgggctccaccctgcctcrctcctcagccctctgccttgctacactgcatgagcccgcttgtcagccccagtrgtggaggccccattcctcaggctcatctctttctctccyagtcaaagtcccaacacgtcgcacattcctggacccccagagctgtggggaccygctgcaggctgtgcatctrttcgccaaggaactggatgcgaaaagcrtcacgctggagaggagccttggaggaggcaagctgggcgcccrggaagccttgtccccatctggaagcctcacccactctataggccccgcccctactctgtccacacctctatcctgaagcccacctccacccaggtctctgctcgtgtctggaagccctgcctccacaccaagcccaccctccacccagaaagtccctggcttgcctgattatagggaagaggatggcagaagggtctgtgaccctctcctggtcctcaaggtcagacctctgcacactgccactggcagtttagtcccaggccttcatggggcagtggggaggggcctttgcaagcttaggggccagacataactgagttctagtcctggctctcccactgacccgctgcatgatcagggtcatggccctgttttgctcagagcctcagtttctcatctgagaaatgggcatgatatctgccttctgggggctaatgtggggacctcccagcactcctcacagggcctggctgtcggcgcttgctctctaagggccagtctcctgctagcctttcttcctgactacaaatcctcagcctcctgtgctcagagacggtagctgctttcactgggagcctgacattatcccctgacactgtctccagacccgctggacagaagccggaaaggggcagggtggaagaatagatgtcattgtcatccatccygggtcacatggggtttgatggcagtcggcgtgctggcatgtgccctgtcctttctttaaggcttggaaacctccccccactgaggaaggcagagaggaatccccatttcacagaggagacaggccaagaaaaggaaagagatggaattcraggtcacactgctggtactcagtttaccaggatttaagctggaaacagtccatgatctggagtcacttttttttttgagaccgagtcttgctctgtcacccagtctgaagtgcagtggcacaatctcagctcactgaaacctctgcctcctgggttcaagtgattttcctgcctcagcttctcaagtagctgggattacaggcatgtgccaccttgtctggttaatttttgtatttttagtagagactgggtttcgccatgttggccaggctggtcagagtcactttctcctcggctcagcctgcccagctcagccagggcagtggcctctggcggtatctgaggtgctgtttccccacagggcggtttggggagctgtgctgtggctgcttgcagctccccggtcgccaggagctgctygtagcygtgcayatgctgagggacagcgcctccgactcacagaggctcggcttcctggccgaggccctcacgctgggccagtttgaccatagccacatcgtgcggctggagggcgttgttacccgaggtagggcccggtgctcccttcctgctgcccagcccacgggtatggggggtggaaatgatggtgtgggagtttggagtgcccctgcctctccaggtccttccctcagctatgggagggagcttcagccagggacctcagctttcactgactcaaggcggyccttctcctggagcggccactctggctcagaatgacctttcttttctttctttctttctttttttttttttttgagatggagtctcgctctgttgcccaggctagagtgcagtggtgagatctcggctcactgcaagctctgcctcctgggatcatgccattctcctgcctcagcctcccgagcagctgggactacaggtgcctgccaccaggcccggctaatttttttgtttttttttttttttagtagagacggggtttcaccatgttagccaggatggtcttgatctcctgacctcgtgatccacctgcctcggcctcccaaagtgctgggattacaggcgtgaaccaccgcgcctggccaggatgacctttctgacctgtgataggtcccctagaatatcactcctagaaagagtgatctttcttagcaagcttgttgcagctcatgaccttggactttgttcacctacagatgtctcctcttttgttccttggcatagaggaccctgggctgggcaggaggatggcgagattagggagcttggtgctggttctggctctcgaggcccagtctgggaccctgggggggaaacttgtgtgcgtgcggagtggagtggacaacttagcatgtgtgttcccatccctgggcacaggaagcaccttgatgattgtcaccgagtacatgagccatggggccctggacggcttcctcagggtgagtggccctggggctgccartgaccactttattctgtaaagcgggcaggggtccctcacttttctctttggtagggcttggaattggcatcatccccactggccgggctgacctgtggtcacagggtgaactaaagcctggygagagctaggtgaccrccctggtgtcacacaacaccaggggatccaagcgcacagccctggcctcagtcttctccctccacagcggcacgaggggcagctggtsgctgggcaactgatggrgttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatggtgagggcgcccccagccaagcctgcctgtgccttctggttcccaccaagctgccctggagcccttaactccccacttctactcctttccctgcccctccacccagttggtcttggcataaatgcgagtgaaccccaccttgaggtcagcttttctgtctttcccagatgtgaagctggagttgggggttgcctgggaggatgacatkyaggctggatctggggctcagtggggtggggaaacctgcgtgtcacccagttcctccttgcccctgacctgcctgcccctacagagtggccrgagcccagcgctatgggccgctcccgagacacttcagtttggccacttcagctctgccagtgacgtgtggagcttyggcatcatcatgtgggaggtgatggcctttggggagcggccttactgggacatgtctggccaagacgtgagtaacccgtggctccagctgcatgccttctgaccctctcagctcaggccccagcttcctgacctctgcccgttggccctcaatcttcctgcctcaggcccctcttctctgtctgcttgcttctggttctgcctggccactgccccaggcttccttgggtgtgtgtgtstgtgtctgtgtcygtgtgtgcgcatgtgtgtgtgtgtgtctgtgbctgtgtgtgtgcatgtgtgtgtgcacrcaccatatgctggggaaacccagagcctcctctctgctccccacccctgtggcccaggtgatcaaggctgtggaggatggcttccggctgccaccccccaggaactgtcctaaccttctgcaccgactaatgctcgactgctggcagaaggacccaggtgagcggccyaggttctcccagatccacagcatcctgagcaagatggtgcaggacccagagccccccaagtgtgccctgactacctgtcccaggtacgttcccacatgggacagccagcctctcacctgtccgtggagggcctccctgcatgttgcaagtgcaaacccaccgcctccaccaccccacctgtccaagagcaattgttcaccccattgccccagagggctgtagcctgcctgcctgcccaggcccacctcactgcacatcctcctggtcacttctgcttctcctggattktgcccacatccccgggtacaatgacctttgactggagaaatagatgtggtaatagccctaacacatttgtagttccaatgaatcaaatatgtgaaattaatattcgttgttcccaatatgagtcaccaaccagtcctaggcgtgtcctaccccagactgttccggatacgccaatacctttagctggcgctggctctgcctccacctgcctgaagaacctgaagccctcgcttcttcacgaatgcacagtgctcatgtgagccagatccagccctggggcccggttaccctccccttctcctgtccatcctcagctggcctctccccgggagaccaccaggtgtgggcccagatcccagctgtcggttgagcacagctcctctgacccgcaggcctcccacyccactagcsgaccgtgccttctccaccttcccctcctttggctctgtgggcgcgtggctggaggccctggacctgtgccgctacaaggacagcttcrcggctgctggctatgggagcctggaggccgtggccgagatgactgcccagtgagtccaaggcaccraggtcaaggccggggctgggggattccacaggccctgcccctgcctatactggggagtcccaacctgtccagagaagcggagggagagtggagggccttcatgggaggagcagaagttggggacaagccagccgagtgtgaccagcctttgtttcagggacctggtgagcctaggcatctctttggctgaacatcgagaggccctcctcagcgggatcagcgccctgcaggcacgagtgctccagctgcagggccagggggtgcaggtgtgagtggaccccattcttccaaggcaggactccggtgggggtccagtcccccagccctgcccaaggaccgtggcaagctgcgctccagcagtgtgggagggagcgctctcttcctctgcttgggcccagatctggtggggccacagcttccccgctttcactgcctgcccctcccattttcacgagtctgaacgccttggctaactcagtgcccctgaaaagaggttcaaatccctagggaggacccctgagataacagcaggaggaaattcggggtctcagagaaaagctggggcagggatgggagggaagacagtgggttgagattgccctggctcatgccctactgccatttgtacccactgggggctggggcctaccccgtggggtgttcccttttcccacagacccattgaccagtcagacagcgtgggtcctgggggggtcttcttctacctggcagtgactgcagctgcctggtggctcaggcgtcgggggctgggccagaggtgcatccacctcagctccctgtgccttggcaggggctgactggacactggccaaggctcaggcaggcaaagatggtgctgagctcaggggctgatacccaagagccctagactcaggatctggtttctgtgtccccctgccttgggctgacagttcagggtgaggccaaaagtcctggccaggccgggccatgagaggccctggtgctccctggggccccatgaggccctcgtgtgcattccttttatgaacttagtggccaggacatctgggaaaagcataaagggccatgttatctccccagggacccaagagcttttctctccagccatggggagggtgaagaggagactcagagatgggtcctctctctcaaacaggctggtctaacccccagtgtacagatgggggaaactgaggccaagtgaggagtcaggagcagagctgaggtcagaacccaatccaggggtaaggctggctctggggagagagtccttggtcctgccctatggcaccaccacttccctgtacagcccttggggactctagaggcgactcccctccagccagctccgtgccttgggcactacccagccttccatggagcccctccctgctctgactttgaagagccctggcagaagtggttgtgctgagcccaccgtggagttccttatccacaagggcccccgggaatggtggggcccagtatgccagagctttcgtagggtggcaggaaggcagctggatctcagcagggccacagggactgagtttgtttaggccgcccgtgacacttgtctgctctgcttggctgtgtgttggtggggtgggatggggcgggaaagaggagacaagaggtaaagatgaaaaagacacacagcctgcccttggggggctcagactagaccaggagaagagctcaggtaccaagaagtaattccagggcaccatccacagtgcccagggccccccaggagccctctgggtcagtgggtaggtgggctggagggggagatagccactctcttaatgtgtgaagttgagatgtaagttgaacagggccttgcaggtgggaaagggaaggttctttccttggggtgggtggagttttcggcaggcaagatggcaggcctcggacaaaaggagtccatgcagagaggctagcatgagaaagagcccagaggcgggaaggtgcagtgcatctttgcagagcacccagaggtgggggacagtgactcacagaggtgcctttggccttaccctgccagcagcagctcccctgctcttggaatctcccccagccccctgcctccctgtctcctgagcacctgccccagctcagtgactctgggggtactggggagaccatgatgttgctaccaccttagtcagggttgggggagcccccggccaggtgccctccaggatccgccttccccacccctcctgggaagcctggaccagcatcccttcttgggtggatggagcctcgtcctcatctccagctacatcagtcattctctgcagggcaaaatctcctccccctaccccagctgtttctgcagaagggcccctggctgtgttggcaggacttcggtgtccagggtagatctcccctccactgaggagtgaggtcccagaatcctgttgggtcccaggcctcagccctgcacagatgtgatgtggggcgatggctctctgggaaccctctacagatctatttttatatggaacttgttcactggacagaggtggcctgcaagcccccattaccctggtctgagctcaccctgggagggagggggccagtcggagggggttccttctggagatgtttttatatttcttgggttctctatgcaggataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagaggtgagtccaacactgctcctgccgtgaaagatgtcccaggatccatggcaggacggtgtgacccagggtaccgaggggaactgggtgccctgggtatgtagagaagtctgttacccagtctcaggagcagtagaaccagggaggtgtctgagacatggtggtgtcctttgctgggatagacagtaccagggagggcagagaccaggaaaggtgctcagtgctcagttttggatatgtgtttgagatgcctgtgggatgtgcggcagagatgtctaggaggcaggtggatatctggtctgaacctcggagcacagatgtaagttagagacagagctttggggtcatcagcattcagatgggggtagaagccagggtgagaaggaggtcacccggccagcatgttcaggagaggggagacgtcagtgttgggaggcacctggatgaaggggagcagtgggagatgccaggaggagctgtgccattgctgctgaagatgaagttttggtgttaaatacagagaaaaatggccgggttcggtggctcatgcctgtaatcccagcactttgagaggttgaggtgggtagatcacttgaggccaggagtttgagaccagcctggccaacatggtgaaaccccatctctactaaaaacacataaattagctgggtgtggtggtgggtgcctgtaatcccagctactcaggaggatgacacaggagaatcacttgaacccaggagatggaggttgcagtgggccgagattgtgccactatactccagcctgggtgacagagcagaaaaacaaataacaacaacaacaaaaacagagaaatcaagtgaaagaggagggaggagtggctgtcagtgtgggcactgggctattatcagtgagtgtattcatttgcttgggctactgtaacacagcacctcagactgtaacacagcacccatgggtttgccgacagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctgtaagtccaaatttcccctttttatggatgccagtcatattgaaccggtccataccagcccaccctaacatcctcattttaacttaatcacccctttaaagggcctgtctccaagtacggtcaccttctgagttactgggagttaggacttcaacatagaggcctggcggggggcacaattcaacccgtaacagcgacctttgttgtcagggcagaagccagatgagaggattggggagtggagtttgggaatctttgaggagtccagcaaaaggaggaagagtgggctgagacaatgaccaggacaggctgcaggtgtgggccaaaggctgcaggggcaaggcctgagtgcgcatgcatgtgaacacatatgtactcatggacacacgtgcacacacacacttggaccacatgagtccttgcatgtctcagttggcttgctagtgcttctcctctccctggcccgggccattcatgttctttaggctgcggaaggcgtcttcctcctctgcatagttcaggacatgcaaagtgcttagggcaaggggtaggatggtggggatggtgataaataagaccccttcccccactgcctgtgctcagagccagttaaatactaattccttgggacaggtggagagcaaaatatcagctctttgataaggctaactggagaatgttgcttaccaagtttctttgaatctaagatgccattgagtgtaagatgtcctaccaagaaagaaacatcacagccaactatgttgtgccatccaactgaaagatgcatcccagtttcagagatgttaacatgtacgtcttcaataaatgagatgccgcgcatcagggacaaagtatgtttcccatcattcccctgaactagacccacccagtcccaggctgagccgggtggggcagacatccactgcaggggcagaactgtcccctcagctcctgcctgcacgatgggagcagagcagggtgcacctttcttgtgggcaagcagatctgcagaagccagatggcactgagtcaagcaggttgttccttctgtccctcaattccacttgagaagccaccctctggtggggaggaatgaatgaggagtgggttagagatgttagcagcattgctccactgaagtcagccccaggagaggcatgcagccagggaatgcaggaccccagcattaacacagtgcctggcacacagaacacaggaaatgcccactcgttattagtattactattattattattattattattattattattattacctagctggtgtgaggcaccaggtagacatataacatgtggtcaggaatggaacttctctaggcagtgggcctgctgatctggcttgacaaggtatttgctcattcactgcacatggaccaggcacatactagatggctggctctggcaagttaaggccttactgcccaatgggcgagtcagttaagtaaaaagtacccacgccatggcaataaggatgaattctaggtgttttggggctcaggggaaggctctgcctgacttcatccccgaggaggtgtgagcgggctcctagaggaaagtgggtagtgtgttagctgtctttggtagccaaagcctgtgttctggaccttacaggagggcatctcagttcctaacgttacctctgccccacggctcaggatgtgagtaaaattcacactgcaccacctgcagctctctttaaatctctttgtaccctttgccattgaaatggaactgtctgccagtatcttgaaaaaatcctgctatttgcaggatatttcccaccacagtttactagttgagccccttggggtctttgggcaacagagagaagccagaagttgtttgggctcatgaatgatctcatgttgcctatcagcatcttgggagcggattatgggtatctcgagcctagttccagggaatatgtttgatcaagactgcttgtagaagtgtaagaggaaaatgaaaaaatcaaaaccaaacttgtttccccattgcagcacctttcctcccctttcatttaggcttctcctgggccccttttccttcctccaccccacagcattccttttttcttttttttttttttttttttgagacacaagtcttgctctgtcacccaggctggagtgcagtggcatgatctcggctcactgtaccctctgcctcatgggtccaagtgattctcttgcctcagtaagtagctgggattataggcatgttctaccacacctggctgatttttgtatttttagtagagatggggttttgccgttttggccaggctggtcccgaatccctgacctcaggtgatctgtccacctcggccctccaaa

SEQ ID NO: 12482 - DNA, 27227 bp, Homo sapiens
atgggaaaagaaatccagctaaagcctaaggcaaatgtctcttcttacgttcactttttgctgaattacagaaacaaattcaaggagcagcagccaaatacctacgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggcacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgtatttcctgttcctggtctcatgtgtggcattagagtagctgtgactgatgctttgtggaggagggagtggcttggtagaggagagactgatcctgaggaggggaacggagaggacgggaagggaaagaaggggaagggaggagaggagggaggggaagggaagagaggggaagggaagggaaaggaggggaatggaggggagggaaagggagggaagggctggctttgagagaagtgtcagcagtaaacaaaaggtgtgacttgggccactgggtgggagcctccaggtgtaaagtagcagcagtcatggaggtagaagcaccgtggttctgagtggtgatccaggtgagaggaccctactcagtgtcaggttcaggaacatgacgtctgactctgctaagcagtggcaggactgggaagactgccagggctagaaggcctagagttcaagctcacacttgaggccccaggagaaacatatggcatctgagttgagacaggcctgagggaacccaggatttccagcaacacttagatacgctcagtggggccagggtgaactcccaggggtgttccctaatcaggaggaggcaaggggcagattttaccaaaaaaaaaaaaaaaaagcagggggctggggaaccagatcaatcgtttttcagtggatagatgtataatatgtggcctccactcctcttcctcttgttcatagcactctgactccctttcgtgaccaaggctggataagagggcaggatcgccttggccacagtcattggctcagtggtgggcatgtgacccaagttggtcctatcagggtggacctctggacctgtgtaaggagtcctgggggacaccgcagtccagggaatgtggacagccatttgccatctcatagggcccaagaaggaggccgagatgctagaatccctgtggcatcagaacagtctcctaaacttttcattgaagatgaacaacacatttcattttttccctgagatggtttgacttaggttttttcctacttgactataatttgacacaaatgggattgtgctgtaagtgtctgtctggtaactagatttttcaggcaagaatatactgtaggcaacattccataccaatcaataaagattgaaatggaatattttgaaatggttcttctgacttcttgacatcaaaaatactgggccaaaatgcaaagctgcttttttgtcaccagtttatacatgcaacagatctccctaactccacctctaaggacccctattccatgatagagggacctacactttctactctactgcgctgaacagtaaaaatacatatttttgaacagtcttttagaactgcatgagcctttaggggatgagaggtaatacagtgatttagaaattcagggtctggaatcaaacaggtcatttgtggaggattttcatgtgccaggccatttgctgggtacagggaggcacattacgcactactgctaagttcccgccctataaaaaatttccttctgacaggagagatggacttgggcataaattgcagcactgcaaagcaagatgatgaaagtgaatgcagaaagtaatgggggagggactggggaccacccagcaagcctgtgctgcagtcttcatgaaggaagcagccttattccacttgacaactttgtaggcatgctggcaaaattcccgttccgcattccccacagctgctattccaacttggctctgcttctcttccctctcaggagacgcccgcattttctgcttcattgagaaaatagagatcctcagatataagtgctctcagtttccttcattcttgaaatgtaatccataccaatcctttcctcctggtctcacccctcacggagagctatccccctcctgctcttcctgccccctccctgcctccctggggcccttgctccttactataagggtgctggccctccagcctgtacactcatacaagttcacttgatgccatgatatggtggtccccaccttaatgttggcagaacttagggcaagttctcattcctctgagcctcatgttcttatctgtgcaaggaggataatgcctgccttacaggttgttttagcaattaactgaggtaatacatgtaaaagtatttggcacagtcctaaatctaataggtaatatagcggatatactctagggtggctgttccataatcctttcctcctttcttggtgttcacacccttgtataatcccctcctattaagtgtgggctggacaggtgactttcttctaacccatagaatgtggcaaaggagatgggatgtcacttctgtgattatgtgatgataaataatactatatattgctagccactttgctctagggattctccttgctgcttgatgaagtaagtggtcaagtttgagaagcccatgtggcaaggaatgacaaggaactgtgggaaatgtctagaagctgagggtggcctcagaccattagccagtgagaaacagaagttctcagtccaccaaccacaaggaacttaatactgcagcagccacacaagtgggtaggtgaatccttccccagtcaagccagcagatgagaacttggccctggctgaccaaggcctgaagcaatgcacacagctaagctgttactggactcctgaccccacagaaactgtataaatgtaagtttaaaactataaatgtttaaaccatatgagtgtattttgttttaagccactaagtctgtggtaatttgttacacagcaatagagaatacattactcaataaatgccctcttccttataattctagaagagactgtctttaatcttgtttctatctccagcctctaccttccccatttaatttcctttcctttgttaccaatctcttgttaccaacatcttgaaggtggagggccacctcccaccgtccagtgctaattagatcctgatttgtattacccagtagtagttccagttgggttgtcttgtttccagcctgaaatgtgggctcttggtgggcagcagctgtgtgatgtaccacactcctctctgggaagagggcccccacacagctaggccccagctctcatgccacccctttctggtttcctgtgtgattaattatgtgaatgtgggtggccaagtcagagttttgacaagagtttgcagttcccctgctgaaaactaactccattaacagtcctttatgaaaaagacaataggagggtctgaatctgctggcttctaatgactgtaatgtaatgacaatggagagagagggagggaaggaggaggagaagttgggggagcctggacctaagataatgggtgagagaaaaagtagatggacaatctggtgtggtgccagcattccaggcccactcagctggcctcaggtgctcctgtccttgagaagaggaaggcaggcccatcaccatcttgatgactgaatcactcaactctgatccttctctcctcaaccgtttttctgtgttcatgtagtcattaatttacttactcattcattcaacagatatttacataaatcttatgcctgcaatataacagcaactattctggtgctgggaatacaacaaggttcctcatctctcacgttccggtgaggagagacagacaattaaaaaaacaacaaataggccaggcgcggtggctcatacctgtaatcccagcactttgggaggccgaggtgggtgtttcatgaggtcaggaatttgagaccagcctgatcaacatggtgaaaccccatgtctactaaaaatacaaaaattagccaggtgtggtggcacgtgcctgtaatctcagctactcaggaggctgaggcaggagaattgcttgaacccaggaggtggaggttgcagcgagcccagattgcaccattgcactccagcctgggtgacagagtgagactccatcttaacaaacaaacaaacaaacaacacaaatacatatatcgaatcagtttttgatagggtaaagtactcactagaaaataaacgtgggtaatgagataaatgatgatagataggatagagggcacttgaaatggatggtcagaagttttctgcggagctggcatttgggtttggatttaaagggcaagaaggagccagacaagccaaggtgtaagagaagagtcctccaagcagcagggaagcaagtgcaaaggtccttgcagaagcgagcttggcatattagagggacagagggaggccggagcaactggaggtgtgaacaaatgggcgagatgtgtttggaagggtgaaggccttggcaaggggtttatgtggaaatctaagtgcaactgagagccacagagagatttcagtagtggagaaccacgtgcttccatctctgactttgtgttactcatcattctagggtcttcagagactatcaagtgccaacaaggggattacccctctgcccctctaaaggattgcaagaaagaagacaccaaatccatggcattttttcccttaggaaagaagggagataatgagaagcctccacttggtattccttggagcagctggaagctaaaaaccaaatgtgggaactgtgaatcctatctctgggatatgttttctcaggaaatggaggaaatgggtgggcacgggtggcaaaatattccaggggaatacttcttcctgggccttgtggggaacaactcccaaaaggccagtggttctcagctttaagcctgtgttagaatcacctgcagggcttattaaaacacagattgccgggccttacccccagagtttgatttagtatttctgggagttggatctataatttgcatttctgaaagttcccaggtgatactgatgctcctggtcccaggaccacagacaaattctccttcttgtagcccctcattcactctgcgtaggaggcatggctcatctggctggtgggtttgggaggaggagcagaccatgctcagttagccctccccactctccctttctctctctccccatcgccctagctgcagagcatattcagacagctctccaatcagttcatcagtaataaaggtgacatgctgatcctcatctgtttttctcttgcatctgccaattgattctgcacttgagaggggaataagtatatttatttattgggtttccctcaaattccaacagagaagttggtatcagttgcaaaacaatcaactggcatccgggccacacagcagcataggaatcttggttttagcttccactaaaatatcaattatttgagggcaaaaaatgtccaattcctgggcctttaagataggaagtcaggtctgtggatggggtgaggtcaccaggatgaggtcacaaaggcattgatgcccctttgtcctatcatgtgaccacttgtcacacttccatcaaacagtacctgccccttaggtgtgctagggaataaaygaaatgcctgggacatcatcgttaagtggcatctgatgcataagcagtgccctaggaatggggttgcctgccttggtctctaaaggatgggttcaaraggcaagagcagcacacaagaagatagcttcaagcaggagawaaagcttggcccagggcccaaaggggatacgacccttcaggttggccctgacctctgggttggattaccagtgacacaatgaacatttcattatgaggccatcccttgaggtagttgcattgcaacagctctccctacccagtgctgcatttccartgctttctctgttcaggctgctgggtgacatttctatgtctccccttcaacggtgaaatatttcagtggttgtccatcacctatgggagtctgacatggcataatcaggccactggggcattgmtagttgtgctgtccctgatattcaccgtggtaggcagtttctgaaatggctcccagtgatctccaactcctgaaattcacactctgtgtaatcccctccctttgagtgtgggctagacctggtggccaaagtgataggatttcacttctgatgttaggctatgaaaggctgtgaccgctctctctgcctcttctctctcacttgaagcaaactgacatgctgaaagctgccctatggagaggctcatgtggcaaggaacagagggtggcttctggccaacacccagtgaggaactcaggccctcagtcaaacagcctgcaaggaactgaaccctgccaataaccgtaagtaagcctggaagtggatcactcccctttgagatgcctgcagccccagtggacacctttactgcagccttgtgacggactcagctaaactgtacctgattcttgacccatagaaactaataggtgtttcatggcactaaggcttcagataatttgttacaaactgaaatgatgagtacagattttggcatcaagagaaggatagtatcatgacatatacctaaaaatgtgagatagctttggaaccaggcagtgggcagaggtgagaagtattctgagaagcttgttagagaaatcttcaattgcctcaaagacaattgaagacactgtagaaatctggactttgaggatacagctggtgggggcttaaaagaagtgatgaacatgttattggaaactagaatgtctttgtccattttctattgcctgtaacagaatatctaaagctgggtaatttgtaaagaaaagaaatttatttgacagttaccagttacagaggctgaggagtccaaggtcaaagggctgcatctggtgagagccttcttattggtgaggactgtctgcagagaggactgagcatgttgatgtgcctgctcaggtctctcttcttttgttttgtttttgagatggagtctcgctctgttgcccaggctggagtgtagtagcgtgatctcggctcactacagccctcacctcctgggttcaagtgattctcctgtctcagcctcacaagtagctgggactacaggtgtgtgccaccacatctggctaattttcgtatttttcatagagatggggtttcaccgtgtttgccaggctgggctcgaactcctgatccacctgcctcagcctcccaaagtgctgggattacggcacgagccatcatgcctggcctcttcctgttcttataaagccaccagtcccactcttgtgataacccattaatccatggatggattaacccattcatgaagacagggttctcatgatccaatcacctctttaagtccccacctttcaacactaccatattggggattaactttccagcacatgacatttgggggacccatgcaaaccatatcatggagragggacatccttgttaggtagtggtagaaagcttagtgccactattgtctgcagttacatggaaagcaaaatatgtacctaataaacttagtgatctagctatggagatgtccaagcaaagtgttgaaaataatttcttcttactgcttatgtgagaagagagaaaaaaaaaagttaaagtgagacaggacctgatagttttgaaaattctcagtctcccaagtcagcaaaaggtgctaaaattaagaaatggcatttgagcaagaaatggtggtctgagataaagctgtgggtgtgactgtgggcctttggttaagacttcagaaagatcaaaagatcatggtattattcagtcatacaaaggccctttaaagagattagggtaggcctcatagatcctccagatcaaacaatagggactctaggaagccaaggggctgtcccttggccatcttttcaagaggctcaggttgaaaagtttagttctcaaagaaatttgtgggtttgtttttttgtgtaatagagggaatctcagtgcaatttacagaagacccagaaggtttctgagaaaacctatgagaagaaacacagctgggacagaaaggaacagagacagtacaaaataaaatgaggccattggacccctaaaattctcagcaggaaacaggctgagaaaacaagtcagctttaaacacaggtttcctttcatgaaaaaggaaggattactcagagggaagaaccaagagcttagaaggtggagctaagagtcatggagaattatccccaggctttgaaacctaaccaagaaacttgcagtcttttcctggctggatttcaaaattgttacggaccagtgacgcctttgttcctcacattttcctccctttgagtagcagtgtttatagccattcctctatacctaacctgccattgtatgttgggcatatggggggcagataatttatctccttagcttttcaaatcaccaaatctgtagtaacagtattctagaacttgtacttaaggaattatacccaagagcctcatccacacctgcacctgatttagatgatgagatcctggactttcagttggtgctcccacgggaggagatgttagagaccttgggaaggatgattgcattttgtgtgtggaagggacatgtattctgcatgtggaagggacaagaatcattggagagccagagggtagattgtgataggcagcttcagaaatgactctaaatttctttctcttctggtatgtccttgtgcagtcccctccctttgtgtgtgggctggacctagtgatttgcttctaaagaatagaatacagaaaaagtgatagaatgtcacttctcatatcaggttataaaagactgtcacttctgtcttatcctctctctctggctctactctctggcttgctctgatgaagcagctgggttgaaagcttccctttggagaagaactgagggctgtctctggtcaatagcactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaagctttggagtaatatgtgacacagcaacagacacctaacgcacctgccctaaggtcgggctacactgcattttccccagaaacattacactctctcctccccagggcctttgcacatacttctcatctctcctaccttttaggtctggtagacttcaacctgttctacagacttaggtcaggtatcccttcctctaggaagctgtctttgatgctccaactcccttgtgtgttcccataatagcttatgtaagttcatacaatgccatcccaatgcacagcacattatagcaactgtttgtcccctcaactggtagagaagggaagggatcttgccttattcatcacagtgctctaaaatttaacacaatgcgtcacatggagtagaatgataatagcacacttttattgaatgcctacatcatacctggtaagaaataattcattgcaggatttgggcttgtgttagatgatttgggtactgtttgaagccatttaatgcaattattttacttaagaaaaacattcaatgagagcggtactttaaacaccccattttacagacaacttgaacagcaggttaggtgctcagttcatgtttgatggaaaatgaacaattgaatcatgagaagcatgttttttcttctgtcctgtgtctcccttctctcaagaactctttgcaaataccagagtatttgtattttgtgtgtggaagggacatgtattttgcatgtgggccagaaggcctcctgggcatctggacatccactttgtgcttgactggtcatgttacctagcttggtatttccagataagtacctggatctatccctgggtgtctcaaagggagggcttggttagcacccagagagtttgatgggcaccagaaaccacacctccagctcttcgcccacagctgtgcctctggctcccagacagaatcagcattttcctctccccacactctgtcattataaaccacgtaaattcctcgatacccatgttacaacgaacagatgcggctctgtatttttaatgtattatctctaattagcrgcagtgggcatggaagaactctgtggtccctggggctgtccctcactgatgcagctgcgagtacatttgtgatgaagaatctggccaggctcctctggcccgcacagccctggcaagtgggtgagggaacttccatgtgcaaagtatctactctgccaggaagtgggaaagggccgccaaggcctgatcatcagtccactgctcatctagcccccactcccacccctctatgctgtctaaataccctgagaggatgtccttcattgggatcccagagacagggcagacaacagcctccaatgtcatgggcaaaacagatttttctaggtttgaggtctgcagtgtgaagatctgtgaaatgcaaaaagagaatgcttcagtgcccagggcaaacataaggggcgggggaactgcatggacttcagaaaagaagggggctggttagtgagagcaaatgtatgctccttagctctgtccaaagaggaagggtatttcttataataaatgtcatgctcatgactgacatgytttgggcrtttactatggactaagccctatttctaagtgttctccagatatcatcacgtataattctagaggcagtgtcagcccccggccaatgaccaccatggacctccctgtagttgaacaaagttgggtttgctgactggtggcagtgagggagaatgcacaccacagggagctgtgcagtgtctcagtaagaaggtaagaaataattcactgtaggattcgggcttgtgttagttaattgggggagggttcaaggaagcagagctttgccctggattggagactggaggtaggtgtaattctctggttgggtacttcataaattttatttacaaggcaggaggaatgaaggaagataagagttgtaattggtaaagaagcagccatcactcacatcagccaagaggtggagggaggggggctgttaagtcatctttgtattttgaataatgttcttgtttttgtctgaattcatgatgttgaaatggtcttgtttttgtcttcatctatcagggtcctagagtggttttgtccggcattgacattcagtgaaattgtttatggtcaacaggagaaccccaaggtctaggtgtaggtgccaggccagctctcggcagcaaaaggccttactgatagtgccaggccagcttgcagccatcaggggctgctgttctccttctcagcaggccctgttactatgccagtttacagaaataaagaaattgaggcaaagacagattgcctggtcttagttgtctcacagctgggaagcagcagagattccagagtccctgaaagtcaagtgagcatcaagagacaacagagggaactaaaggggagagtttgtaattacgggaagccagcctgaccatgaggggaactggtcaagagatagaacacaggatttgtagtcagagatctctaccttgggaatctgtcattgctacttactagccatgtggccctgggcaatttgtcgaacatgagaaattcactttattcttatgtataatggcaacaccaaaagctgtttctcagggtcatatgggaatagaatgagaagacatggcataaagaacttacgtaccacttgggacacagatgctgccctgagtatttactgmacgccaggcactgttctaagtccctcgcatgtatttactcatctattacagcaascctttataacctgtggcttgcaggtgagaagatggagacacagagaggttaggcgacttgcttgaggtcacacagctatcaagtagcagaactcaggcatcctggctgcagcacccacactctaccatgtgtcatagtagctgtggggtcattgctccttgyccactctaagtgctccagatcatgagcttcaagaccctagtcttattctgatggtgattkaatgccctggaactctcaaggccccagacttttgcttgtgaatgggtctaagctgcttgcttggctctggtccggagagcattcatttccttttagaaggtcaaaacattcttggcatgacagataatatagattcaggttgctgcagtctatagatcaaataaaacatagtattgccttattagtatttctacacctttcagtaagtagtagagtcagagaaaaccctgaaaaatgagtataaactaaagagggtaggagaatgactcaatgctgcagcacaagccctcttttggcaagatcgatgtgtgggcagaaggcaaatggctgctgagaggaaatgggccasacctggctggtcttattctatcctgtaatggcagaaagctgttcaggatggctatggcgcacagcccagggctgactcagcattgcctcttcctaacctgttgagtgggtttatagattgtgtcacaagttctgggaaaatgagaggtcaggattcctgggcccaatggctcgttaacagaggtcctgtgtgccatcaccccctccagtccttgtcccactggacttgtcccccttgtcgcactgggggagatgagggcctggaactcacagcaaaattctctctgtggcttgatgcaatcccagatcctcaccatcaacctttgtgaggctcatctgttcttaattatatctctaaatcccgaggcattacaactctgagaatttgggaaatttagctgcttagaggattcataataatcacaaaatccctggtatttacagagctcccttttgcagactgtgaaaggcagacaagacaatactgtagtggtaaaggcaccccgaaattgctctcaagttctcttcactgaatgccaggcccttagtctgtattattttgtgtagctcaagggggcaaattgaaaagaatacttttccctattactttctgagagagaccacagagaagagagagatgttaagttaatgtcgaagatatgcccagggttgctgccaagcccctgccctcttttcaggattgcgctgctgaagggaggggctcctgcagctatactggtacaagctgagcttgcccctttctagctgcagctgattggacaaggagtggagacactcgactgatgagtggagccaatcagattctctctcttgatagtttgaattaagagatgtggaaactgggagttgggttcctggatttgaaggtcaggcagactcaggggctggagtgaccatttgggaccaagcagagagaaggggaatagaccatgtaatatctgagagttgcttttcagcactttctgcccatgtatttgttcagcaaattctctgattcctaagccaggagccatcccgtgaggccgttactgcaaacaagctgaaaatcctgctttgtttcttttggacacaacatgctttccttcagcttcagtagacgatgaggccagcaccacatgggctagatgtacatgagatgtgagcaaccacacttcccctctgacggggacagacagcatcacaggtgagtgggagacccacatgtggtccattccagacacccccgctgcttttattagaagccaacatgggcctcccttgagctgccaggtgttgggtgcagctgcccctcacctccctagcttacaggagaaggactgagcaaagtctcttcaaaggagccattattgtgacacagcacagccatctgctccccgcattgatctgacagtggcagcaagggctgaaagcagtagtagaggcccaggagcacaattcagtgaacagccctcattgatctgtttacctgcttgatggctggccaaactctctgtgtccgaaagacacccttggaaggtcagagctggaaggacaccttagggaggcctgaggacagtccaagattgtcacaaatgggaaaagcaagccctaaagatactattgagatatgacctttccaatttcaatcaagggaactcagataactcccactgtttatgggacagccctggggagggggacagggtgctattgtgctttgtagtcctatttgccacaggtagtaaagcaaagagaatatctatttatatgaatccataggactgaatcataagctcttgaacgaaaagaaaaagcacattcttcttaccgcggtaacaatgtgtggtcactagttcagaactcccactgtccctaagccacaggatgcagaccaacacaatcaaagagttctctcggctggaggttccaactggaatgtgtgagttggtggcttctatggtgccagcttttgcttagcctttgcttggtcacatattcagggtcaacctgccctgtcccagtgacaattgtctccagcaggaaattcattatgagccccttttccacttgtcgagtagattctggaaatagtctgctgtcctccccaccacctcccactaagatcccaggagccagggatttagtccctggaatccctgcagccttgatcattaaccactccacttaagtgtggcccatctgtctggttggtctgcttcaatctctggtcccatttcttgctcccccatgggctagcagttttgtgaaactgtttctggatggatggactttgggcctactctcccaagggttgggatttatcttccccatatctattaacccacaaatgtccctgacctgaaagtcacacaaatacctgagtcatgtgaccacctcattcccttagactttgccttcccaaaaatgccagtcctgatgagggtaggagattttgtcttacaatattgggtggctgatagcaagcattggtgtctctccccyattcctgctctaaccaccaccactataatcatgagcattggttttagatgaagaaagaactggctttgaatgctgttcccactactaactgtatgaacttggcaagttagcaaaccacattcttctgatcctccttcttcttgtccgtgtaaagggtgaattaaaacctactcaaggtgacaggtgtagagcaaatgagagaacaaatgagagcatgaatataaagaatttagcatagcgcatcacacctgatactaatatgtaacactcattgagagtttataatatgttaagttctatgcaaagtgctttgtaaacattaccttatttaatctgcacagtaatctagtaagatcctattatccaaaattttaaaatgaaaaacctgaagcttgaaaggttaagtaaattgctcaaagttaacagctagtcagtggatgagcaaacactgattgtgacctcatggagaccaaaaatgatgatttatctaatttaatgtcattgtataatgcctattatataccaggcaccccaaaaatgtatgctgaatgagtgtatggctcccaagtcagtgcccctttgcatagctgggttgagagctcagctctgccaacttactgcttctctctctctctctttttgagggaggacataaagctgtttttatttctgccagcatttgtgttcttatccctagtatggctattactggatcttttaatacattcaaactttctatctgaatggatacatttccataccacctactctttaatgagagattaagagatcttaactcacagattcagcacttggacagagctaggatttttgagctaatgtgtagtcggtatgggatttgcatttaaaaactatttacattaaagtgtgacccacatatgagaaaagactgcgctcttcacttacagctcagtggttttggctctctctttcttctcatagtctatgagatgagaaaagatttccataaagattttatgagtccaagagaaacattactcaaacaggatttatttcaaaggcatcattcttgtggcatgctgtttaaaggggaagcaaagctcatattggtacaattcttatactcaaakaaagtacaaattttgcagaatatcctcttaagacctaccaaggggacaacttcttcaatttggttcaaattagcaaaatataaagcattttcagcatctctgggctcatacttgaaaccagtgataagtgacaataagaatatgattttcccccattcaccctgaaacaaggagaaaggtaattactgtattgttatttttggaccttcatgctctgggacaaaaatatatttatgatgcccaggcactgtgctaaacaccacaaggcaaacaaggcacattttctgctcttaatgacctcgctggtagggaagagacatgtacccataagcaacacattacgcagggagaaaagagttatgagagaaatagatacaagctgggaactcattctggagttctgtcagggcatttattgtctttctgtctagtggacaaactcctattcattttcctgcaaccctcctctgtgaatcctttcctgatcctctgagacagtcagycttccctccttggggttcccacaaatgttgaagaaaagtaaaatgagaataacagctactaaataagtaattattaagtatataaaaactgttctgtaggagaaaggggcaggaaataattaactgtcaaggaagaagtggagatgcctgaattagttcttgaaaaatgtggggaaggtcgttttggctagggaaagcaggaagcatgaaggcatggcagcatggcagtatgcatagttatggtgtgtttacagaatgccaagcagcgtggggtagttaaagcaaggtgcaagggagggaatggtgtggggaactgaagatgatggggaggaagtgacagaaaatgaaggagctgagttgggatggagtcggattataaaatcttctgttagaaaatttgttcctaatcctgtaggtggtgggagctttcaaaatatattttaacttttacttgtttttctgtgtgcagaaagtaatataagcttattataaaacttagaaatacaaaagaacataaataataaaatgcattagtactgtgtatttaaactacatattcagttttgtatattaattttttaacttaatatcctatattaagcattttcaaatttattcgaaagtttctgaaattataattttaatccccatgtgttgtatcagccacaggtgccagtttatggaaccattaatattggacatatactgtttccttttccccattataataaataatgctgcagtgaacatccttgcacatatcattttgcaccagcctctcactattccctagttccttggtataaatccctaaaagtggtatccacatttcacgttttaattcctaccatgaaaattaccttccaaaaaagttgtgccatttataatcccaccaacaggacatgaagttctaagaggttcagtgacttgtctaagattaaacagctatgaatggagaactggaggcaaatgtgagtactggtatccacggggctatggcagaacttcagtggggagatgggagtggggtggccagaggtaattgagtctggaggactgaaagtgacttaggtgaagactgatggtctaatgagacagcttcaaaggacaggctgtcaatggacaacatttgtaatttcatactttctctaaagctgcctatgtcacgactcttcccacttgagaatgttcagaccaaagagaaatgaaacatatctacctttctattgactgttaatcctttgtagaatagggcattaggctggcattagtgataagggcacatgtgaaaacttgcctgtttctctaaaatttggttcaaggaggattccccattaatgccatgagttcactgcagaggtcaacactgggcatacacttcaatcatccataaagaaaaatggaggtacctatctctttgaggtcacagcatgctttctcagttgtttcctagttaagaaattactcaataaagaatggaagattcaggatccatagttttctcaatcctcataccctgaatttactagctaacttccccctttcctttcttccttccattcttccttctttccttcccttctcttcctccttttcttcccttcgtggctacggatgcagtctagagccaacaggagcaccaaattcaggcaatcaagttatcaaagctccatatcttactcatcacaggcttgaaagggattcagagtcatgtactccagcctacttcataaattctctctaccacaccagctggaggctggtgtttgtccagcccctccttgactcttccaatggtctccccaaggaagctattccattttattacaaagatctttgcactgagtcaaggtttgactcctgcaactacccattggttcagtttctcccagttatttaaactttcttccatagaatggacatttagctacccaaaaacaggkgccattttcctctcagtaggtgatatattggtatatgtcttaggctrcggagtaaaaaagaccygggcttccaattttgaatctgccagcaaccagctgtgtgtrgttgggcaagttgctaaatatctccgagcctcagatgatttcctctagaataaatgatgacacatttacctcacctcatttagtaaggactaaatgaaatgtcaatagtagggcaaattgtggatggttgttagatgttaggtcccctcacagttgccttttttttttaagtcagtatttctccaaggtggtctctgactagttgtatcgagatagcctagggtgagtattgaaaatgtagatttccggatcaactcctaatcaaccgagttatagtctgtgagtgtgaaatctagacactttcatttgtttagttcagagaagtatccatggagccaagaagttagaaggccttaacacatatgggaactctccaagccttctcagggagtctacagtcaaagacccatatgatccctgggacacatgccttgaattgggaaacaaggccccactttcaagatgtttcttttgcccactctcagatagaagccttccctcttattatggaatttggacttggaagagattggcaatggccaatgaagaccagggctcttcaatataacttagaaggagttagaaggagagggtcagccctagaaggaggatgagctgggcagggcggggctggggttcatgggccastgcaacagactggaattcagtggactctctaggccaggcaggaagctagagggcctcccatgaccatagcagacacacagtggacacacagtggaattcccagggctttccctgacatgctggatgtcagcgcaatcaactccatgcccaccctctctagtggatgagtctasgctyccaggaagtcctaatactctaatttattctgcttgtcctcttgtcctctcatcctccctttttccctgttgtgtcccmgttgtaagctctctcctcacacctaagctgatggctcccagacatctattttcaacctttactcctccccaaaactttagatccttacatccttctacctctggcatcccaggggcacctcaaacttaagatgccatcaccccaggggcacctcaaacttaagatgatcaccccctttgccacttcctgccatcccacacactggccactcaaaccaagggctgacagccatcttattcctcctcccgctttgtccctcaggttaattgcattgctaaccaaatgatgctgtttttaagtctgttaaacctctccctcctctcagtctccactaatactgtctgtgttaattcaggcctcatcatctctcacctgggcaactgcaacaatgagcagtttgtgtctgtgcctgcatccatccttccatcctgtactccagcagcagccagggtggtctttcaaaaatgcaaagctgataatgttactcccctgctgtaaaccttccagcggtttcctattgccttcagaataaaatacgaatcatctggcctccatctatctctccaggctcatcctctctcaattttccatatccttcaggtactttcccaggcatagaagctaagaattccccctttgtccagagccctaggctgaccaagccccactgaagaccatgctttctgatttctgcctctgtcatttccttattgtccctgctcccaatccagctcactgtccaattcagcatggacaggagagacatggaaagaaaaacaactgttataattattgccaaaagctgtgttctgttactatgcattgtgcatagtaagagttcacattaaattcctcattttaattctcacagtatcctgttgggacagacagatgaagaaccagagaccagagagkttaagtagcttgccaaaggtcacacagcagtgtaagcagtacgggtgattcttaagcccacattgtttgacttccgagacatatcagaaaactacgtcaaagaacacgcacaactcagacctatttccagtggcctatgcagaagagctaccctgcttgaatggaaaccccttaagatacactattctcaaaaacctaagtgcttagcctggcttatggaggaggcaatgcaatctaccacaagatgattaagacaacaatgaacttaagwcccagccactgctggagaatatctgcctgtgaattcaatttggttcaattcaatccgatttaattcagtgcagttattgagtgcccaccacataccccatagggctggtccagagagaaacgcaggggtccctcctgggaaattataactaacccaagcatgggcaccacatgaggaagcaggaatgggggttctgggatctggggttcaaggcaggaatcttgtggtcagccctggagcacttaggagaagaatctgccaaattcctatgccagtgtctggttggcagcaagctctataatttttaagtagtatgaattctgtgcccatatttcttacaaaatatgtgtatggagaaagataccaccagtttagtctaataggtattctcaggcctaatatatatgaaagaaattgggactggtgagtggttaagagcatgggcttgggagacaaagtcttggctctattacttcctagctgagccatcttgggcaggctaggttaactttctgggctcaatttcctcatgtgtcaaaggggaatgaaaataataccagcctcatagggttattaaaagggttaagacagattatgcatatcgagtgcttagcctggccccaaagtgcctagaaagggtgcaaaaagtgttagtgaatacaattcttatggtcgctgatacttaataaatgtctcctgaataaaagaatgcatgagtggaatgtacaacttaggagagacagatagctagaggatactggatgctgagctaaggctctggactatattccatgggtgacaggagccatcaaagagttttcagcaaggaaacagcacagccagatttggtttagaaaggtcacactggaccagaatagaggatgggcaggagggagaaattctggagacaagcaggaggctgcttcagtgttccaggtgtgagagcacctaaacaaagtcgggcgtactggtgttgcagagaaagggaaaaattggaaagatacttaggaggcagaactggcaggacttggcaaccaagagatgggagcagatgacaaccaccctgctctgtgcaatgtcagaaaagaagaatccagttagggaatcaggggagaagctgatggcctctctggaagcccccagccactgttttcaccgggaatgctgagtgctgcttgttcctctgccccagcacagagcagaggttcatgtgtggcctgcacacagcgtggggcacagtgggcagccgatgggaaattcttctgcataacagatctcagagcttacaactggggccagcagccagccgcaggaaagggtttccccttggcagacaggcctcggctaagggacagaagtcattcctaattgcagcatgtttttcaggggaagtctccaaagctgtttagaaaataaaacctctgaaaacagtccaaataaagggaaagtgactcccatttgtttagagctactttgtgctgagtgccatcactagtttgttctcactcagccttcagcatgactgaagaagaattagctgcacattttacagagggggacactgagactcagaggtttttttttttaaatttatttaaatacgaccatttttcagtggaggaatcagaattcaaacccatctctttgactccaaagtccgttctctttcttctatgacatattttataatccttaattttaaaaggtctgtttcctcggacattcacatactgtggcagtgtaaaatgatcaaatgcttttagaaaacaatttggcaataagaatcaagtatcttaaaaaatattcattctgggaattgctcctaaagaaataatcataaattcagaaaaaaaaaaagctttgcacacaaaaatgttccttgcagcaatatttataacataaacaacgaggaacagcctaaatgttcacagaaagaggaatggttaagtaagctgtgatatatccacttaatgaatattttgaggtcaagggtttataataacagagaaaatgctaatgttataagtgcagaataatcaggatacaaaattgtacttagcctcatcaagcgatggtgttacagaaccactgggtttccatttagagaactttcctctccaacctctatcagctccttccaaatcactccagagtttttaaaaaataacactacttaataagaaaaacacataatttcttaatgttatataatgggagaaaaaactctagaactaattttgctgtttttattgatctgtaatatagaatttagtaaaagctatgcttgcctttaagtccctcttattcagaaattctagagctgccaaacctatcactcctctttaatataataattctggaggcagtagtcatataagaagccaaaaaaaaagcatccatgtgggaaagaagaaataaaattacattacttgcagctaatatgattgtctaatctagaaaatctaaaataatcaactttaaaactattagggctgatgagagagttcagtaagatggctggttacagaagaaatgtacagaaatcaatagctttcttatttaccagcaataagcaactagaaaaaaaatgcagtgacaaatggccctattcactataacaataaaaactataaaaggacctaggaaaaaaacctaacaagaaattcactagacttatgtgatgaaaactataaaattttattcaagatcattaaaaaaggcctggaaaataagaggcataccatcgtccaggataggaatatttactgtaaaaattttaattctctccaaatcaatctacaaattcagtgaaatttcaacgaaagtcacagtgaaatttctttgggggaaatctgaaaaatttactctaaaattcatctggaaaagtaaacgcacaacaattgtcaacaaatattttcaaagtaataataatgaaggaggtcttttctgggtagaaaacaaaaattattacaaagctatggcaaaattcaaatgatacaattatgacacagaaatagattaacagagaaataaaatagaagaaaaagtccagttgtagaaccatgaatagagctgaactcagtttatgatgaaaggactatttcaaatcagaaaggacaggtttggagttaattcattattcatttataactaaaataaagctagatctatagctcaaacctcgtacaaaaatataattcacacagattaaatagctaaatgtaaaatataaaaattctgagagttccagaataaatagagaagactatttctataatttccaagcaggaaggtattcctaaccaagacacaaaactgagaagttttatgtgatcaaatcaggagatcaactgatttttgttgttgttgttgttgttgttgttgttgagatggagtctccctctgtcgcccaggctggagtgcagtggcgcaatatcggctcactgcaagctccgcctcccaggtacatgccattctcctgcctcagcctccctagtagctgggactataggcgcccgccaccacgcccggctaattttgttttgtatttttagtagagacggagtttcaccatgttagccaggacagtctccatctcctgaccttgtgatccgcccaccttagcctcccaaagtgctgggattacaggcgtgagccactgcgcccggccaagatcaactgatttcaacacacacacacaaaataaaacttatgctgtgagagacaacaaagtaaggctaaaagacatgctactgattgataaaacctttttacaacatatattgattttaatacatgttaaaaatatacaaagagctcctataaatgaataggaaaaacaaacatgacctgatagaaaaatgggtagagaatatgaacaggcaatccagaaaataaaagtgaccatggacatatgaagagattactaactacactaataattggaggaatgtttttcacccactgagatggataaaaacaaaactttaatttggaaaagagttagggaaatagccactgttatacatggttgatggaaacatgaaattggcacagtctttctggagtacactttagcagagtctaaatttaaaaataatgtatactttgacccagaaattctattttaaagaaagctatcctattaatgctccaatgtgcactgaggtatattcatgatgatgttaactataacattatttgaaatagtgaaaaatgcaattattagggaaattgttaaaaaaaatgaggctgacatatatatatatactgacattgaaacatatttaacgtagacatttaagagaataaaagcaagctgtagaataatatgtttatgtttcacctcctatcctgtgtgtgtgtgtgtgtgtgtgtgtgtgtgtgcatgcgccagcgtgtgtgtgtgtaatgcctaggctaatagaccaacttaataatgcttagggaagacagtggaattagggtagggatttaacacatagacgactttaacgttttattctgtactctcaggtatgctttgaatttttcacaaagagtataaattactcataataaaaagtgggtatatacttaaacacatacacacacactcacacaatactctatgaacacagctctttaaaaacaaagccatacctataaaaaaaagagaaagaaatgaatcaaaatgttcatgcatagagtttctttattcagtttttctcaattttctaaattttctttaatgaccatgctttatgtttacaatggaaataaaaaatataatactcgtctgcttttgtggggatctaaatatatataaaagaatatacatattctttttctttcttttttttttttttttgagatggagtctggctctgtcacccaggctggagtgcagtggagcgatcgttgctcactgcaagctccgcctcccgggtgcacaccattctcctgcctcagcctcccaagtagctgggagtaaaggcgtctgccaccacgcctggctaattttttgtatttttagtagagacggggtttcaccatgttagccaggatggtctcgatctcctgaccttgtgatctgcctgccttggcctcccaaagtgctgggattacaggcatgagacaccgtgccctgcctattcttttaaaattaaatttttttttgtgggctctttttttcagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgctgcatatctacaactatctgatttttgacaaacctgagaaaaacaagcaatggggaaaggattccctatttaataaatggtactgggaaaactggctagccatatgcagaaagctgaaactggatcccttccttacaccttatacaaaaattaattcaagatggattaaagacttaaataaacgttagacctaaaaccataaaaaccctagaagaaaacctaggcattatcattcaggacataggcatgggcaaagacttcatgtctaaaacaccaaaagcaatggcaacaaaagccagaattgacaaatgggatctaattaaactaaagagcttctgcacagcaaaagaaactaccatcagagtgaacagcaacctaaaaaacgggagaaaatttttgcaacctactcatctgacaaagggctaatatccagaatctacaatgaactcaaacaaatttacaagaaaaaaaaaacaaccccatcaaaaagtgggcgaaggacatgaacagacatttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaa

SEQ ID NO: 12483 - DNA, 15059 bp, Homo sapiens
tctggagttactgtaagctgaaaggaaacaatataaccaggtcttcattttcaccaaactgcctctgcacttatcaagtatgaaaacacagccctagagtgtgcattttagcagcacactgccataaacagagacttagaaaaacacccaagtaacttatttgcttctggtttcccaggatgtgcagtactccatgacagtggacacaaagaatctgtttgtaaggcccataagagtcaagttctgtatgagagaaacagacactactactaccatgagctagcagcatggtgttggtgtggttggtaatatttgatggcaatggcaattctcctttgtgttatatttaatgcagaacggattatgtgatgttcaaggtggtggcagtagaaggagactaggtctggaaggtcttcatgtcctatcagttactcaaagacttgagtctccatctgtatagcgtgttagcccaacactgggaagtgtgcacactaggtttgtgagtgatggtaatctagccaatcatagacttcaggttatggtcaaggacactgagatgccacctatgtattccagattcagacaacaactgctgctggtcagctgtttctttcagctctactggctacatcttgacagacctcaggaatatggggtctgtcacttagattcctcacttagcatatactatggttttagtattcctttgttttcttgttggcctgcttctttacacagtagatgttcaaataattactgtgatatgaaaatatgttataattttcaagtatttccttatatttctttagcatatctaaattgattatttatgctttgtattttgtagtcagagtttcaggtttcttcccctcaccccgtattctttgccctctctacacctttggatttcttcattatttactaattttcgatattgtatttagccatattattttcttttcttttttttttttttttgagatggagtctcgctctgttgcccaggctggagtgcagtggcgccatctcagctcactgcaagctctgcctcccgggttcacgccattctcctgcctcagcctcccgagtagctgggactccaggcgcctgccaccatgcccagctaattttttgtatttttagtagagacagggtttcaccgtgttagctaggatggtctcgatctcctgacctcgtgatccacctgccttggcctcccaaagtgctgggattacaggcataagccacagcacccagtccatattttcttttaaagtaaaatttcaatagtgatcttagtgaaaattcaatcatctaccagattacctaaacctgatttaagttttaacctattttaatcataaaaaaaagtctgagatttttggaagaggtcatacctctgtctctctcatctctatttccatctatatctgtctatctagctttatctgcagtcctggtcaagatttttattttcaaggggacagattgtcctaatagactctgatggttctccttaaacaaaattgggcaagattcttgtgcaggtatcattttaaaaaccttttcttgcttatttgtactgtgggaagagaataaacaacaccatttcccctttttgagttatatttatttcttgtttcatttgcttgtttgtttgttgttgttgttgttgtttgagacagggtgtcgctctgtctcccaagctggagtgcagtggtgtgatctcggcttactgcaacctctgcctccagggcacaagtgacgctaacaccccagccccctatgtagctgggactatgggcgtgagccaccacacctggctgattttttttttttttttttggtagacatggggctttgccacattgcaggctggtcttcaaaactcctggactcaagcaatccacccatcttggactcccaaagtgctgggattacaggtgtgagccaccacgtgtagccgacctttattttgaaatcttgtttgcttgagcttcatgaaatgtatgtcttgatagattatggggaaacttatttgtatcctcaataaggtaaaagtaaattagttgaatatgcccccaattttcacactagattagggtaataaactatgccagaacactcccttcttgtcctagaatatttctcttatattttctgcagaatcttagtgttagatcactgaaaacccctccttcttctgccatcttatggctgagtaagtaaagccagcttgtgggcagaaggcattgaaaggctgaagatccctctctattgaaagagggatactagtggggataatatctccatatcatttggcattatctttgataggaaaatggtcatgtaaatccctttgactaccctttctcctaattcttgtaattttcatctcatggcagtcaaaagatcaaatcaccctttagtccaaaaaagagagaggcaagcttaattatgacagatactcaaacaatgtgttcttatttagtttttgaatggctgtacttttgtaataagactgtaatgacttgctttcatttttggtatgtttttgaaaatatttttctattcctgtatatgaaattatttgtgtaacattttaatatgttagattttattaaatgaatcttcaaaattatgaaagtgactcctaggataatgtctctgcttgtgcagcatatgaaaagtaaagcgaaacctaagaaattaaacctactgtaataacataatttttaaattatgcaatagattcccctcattataatataaataattactatatgtaaacatatttcattcagacttataaatatgctataaattataatctaatatatatgattccttattaaaggagattaagaaaataagagcatttgtaaagaaggaaggtgtattctcatcaaggtttaagaaaataaatgatttaaaatagcatagcggatataatgcatttaaagctggaaacctatatacgaatataaaatattggtgttggttatataatctttgaaaaagagaaacttacttctatttctaggtgtgttaatagcattgaaatgaaagatgggtaaaaccttctgaattgtgaggacacatgacaacatgagaggttttaaaatttttttcacaataaaacctaatgtgttcttggttattgtatcctctgaaatatcttagatattaagttttctattctccagcttgtgagaagagattatgttattttcttcatattacctattttcctctcctttatgttatcccaaattaaccataactgctttagttcagaaaacctgtccaaaggaaatagccatatacctggttaaatataaaatttcgagtaacctaccagttataatttgcctgtatgatataactgatcttcactacatctatttcggaccctaatcaggttttgcagattatataaaaagctgtttttaaagacttggaccttgggtgttattcacctcaatgaatttgtttaatgctcaatgtcaatgaattaacatattttgaattattataacatccatataaaagtaataatcatggaaagcaaaaaataatatcaacaggtagagataggcatttgttttctaaatgttaagaaaaggaacctgtgattatcctttttttagccagttacaagatgataaatgagagctttttaaaatattatgctattgttacatttaataaatcatccagtccagttttctgaaaatacaggggatagaagaacaggttaaatgataccatgaggaaacaatcaaatttggaatgtaggacatcctacaaaacaactagtctggacacttcagaaatctaatgtcattaaagatgggggagtattctagagtaaatagatctaatagccaaatacaattatcaaagttggttgaaaaagtttctaagacattccttataacaaatagttaaaaaagtaagtgcatttgtcaaaggaacttgagtgagtgtgaattcttatcaaaattgaggaaaagataatggaaagacagtgaaatttgattggggctggattttagataactgtagaatttttttaaattttcttaggtatgatagaaccattatgattatatgagataatattataattatgtgatacctgctgaaatatttagaggtgaaatatgatgtctgcaagttactttcatataagtcatcagaaaagcgggtgtgtgtacagaataagatagaacaaatatggtaaaatataaacaattgttaagtttggatggaggttagagttgtagtttatgtatagttcttttaactgttctatatatttaatttttttcttcatcccccaattttttaacccaatggatcttttagagacacatcctaatatttattattattattattattttgagatggagtctcgctttgtcaccaggcttggagtgcaatggcatgatctcagctcactgcaatctccgcctcccgggttcaagtgattctcctgcctcaccctcccaagtagctgggattacaggcacccatcaccatgcctggctcattttttttgtatttttagtagagatggggtttcaccaggttggccaggatggtcttgatctcttgacctcgtgatctgcctgcctcggcctcccaaagtaaaattattttttaaagcagccttagagtttacagaaaattgagcaaatagtacaaacagttcccctcacataccgattttctcccactcaaagtttccctgttatcaaaatcttgcattactgtggtacatttgttacaattgatgagccaatactggtaaattattaactaaatttcatagtttagtgttcactctttgtgttgtatagttctgtggattttgacaacggcataatgtcatgtatctaccattgtagtatcgtaaagtaccccatgtttaacctcttcatccccctccctcttcttcctagctatcacttgtcttttaaatgtctctataatttggcctttttcagagtatcatgtaatttgaattatacagtatcattgccttttcagactggattctttcactgagaaatatgcatttaagtttccttcatgtcattctgtggcttgataacttctttatattaacattaaaaaagaaacaaaaagacaaaattaaaaaacctaacaacaaacaatgacatatataccctgtttggaagcagattgaagaaaccatcactgaaaagacatttttaaagataattggggaaactggaatatttactggctatttaatattatgaaattgctctttgctagatgtggtaattgaattgaggttatgttgaaagttctcctaggcattagaaaggaaaataatattgatacatttacaataaggaaatatctggctgctcttggagagtttcatgaggctcagacacatcaaagttcaggaaaatgtgaagtgggagcagtgcaaagaaagaaatatgagtaaggagactatttcagtgcccattaaaatactcttatttggattctgtgcttttcctgggtctctgtttttcagctgggtttgagtgtgatgatggtaatctaaccaccactgagttgcacacatgcccaaactctgaataaaaatagaactttcttagtctaagccttctttccgaagcatgctaggactgagatcactcccttccaggttctgaaatttattttttccagtttgaaaaaaaaaaaaagcttggatttgtgagggaagtgaagatttatttattcttgccctgtctctatgggtgcaatgaagagcctttcgaaacgccaataagacttcggtacactgagagacactacttgaaaatactcaatttcgattgccatcagcctgaaagaaagcactgggattttcttaaagtttaggagaaaataaatactcggaagagacgcggggtggcgctgcagccttagaagtagcagaaacaaagcacccagccgacgctcccttacccagatactcagctaaagaagcagcaagcaggaagaggaggctttctaaggcggtcgctccgggaaatccgggccctaggattgtccactcatcccagtatcagcgagatacggggagayagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacrtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataacmgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagsgagcgcgacgckgccaagcagaggctggtggtgctggtcaaggacaatggcgagcctccgcgctcggccaccgccacgctgcacgtgctcctggtggacggcttctcccagccctacctgctkctcccggaggcggcaccggcccaggcccaggcckacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggagrmtccgggacaaatgagttcaagttcctgaagccaattatccccaacttcgttgctcagggtgcagagagggttagcgaggcaaatcccagtttcaggaagagctttgaattcasttaagtgttaataaggatctactgagsctagtctcgtttaatytgtggaaagtccttttttactgctttgcccattggaggtgtctccttttattagaaagtaaccatcttattccaattctatgcrtgttactggtrtttataaatgtatgagtttttttgcggtataatraatgtaaattttctttgtattctaattgttggttagtttcattgcaatttaattgcatttaaagtgtaaaagtaaattttgtattttcagaaatctttaagttagagcatcttttccagacctcacagtctatggtcctagataattttgaagtcctacatttgaaaatatttgttatcattacatgagttatattttccagcccagaatatttgtgttttttatatcctcttaggctagtgtaaattctatcctgtgaattcacattggctaaccctttaaataggtatatttatgaataatatagcaagcaccgtccttacgtttttcaatatatgtaatttttttttttttttgagatggagttttgcacttgttgctcaggctgtagtggagtgcaatggcgcaatctcggctcgccgcaacctctgcctcccgggttcaagcgattctcctgcctcagcctcccaagtagctgggattacaggcatgcatcattatgcccggctaattttgtatttttagtagagacagggtgtctccatgttggtcaggttggtcttgaactcctgaccttaggtgatctgcccacctcagcctcccaaagtgctgggattacaggcgtgagccaccgccccccagtccaatatgtatacttctttcaagtgttgacatatgaaaagtattagtctttagagattgtaagaattttaactgttggattctacaaggcactaacatcataagtgctctaataaatttttgtcaaaagtcaatcattaatattcaaaaatgtagataaataatacatgtctagcaattttcaaaggcatgctaattcatcatgctttctctttcaaatagtttttttaagagccctctgcttattccagtccccccctttaaaatcttttaaaattattaataacctattaactttgagcacttcattaaaatccaaaaaatttgagggagtacatgtctttgtcctttacctttagaaccctcaaacatagcttggtattgctgtttttaaaattttctggagcatttaggattcacttagaaacaagcctttagggagaaaaatttatctagcaccactcactctatttttttgcactgactacttctatttttccccctttcatttccctagacttttcaatgcttttttataaaggtgcttgagttctgtttctcaacagctccctcatttattgaatgattcacacagtcactggaatattataggctcttaataaaatttttgaatgattgaaagagagaaaagtattttacctgtgatatattgatatttaaataaactagaacacttaaaggaaaacattttgctggaatcaaatactctttggtgtacaatgaattataattttgttattaattgaattggttaccattgtttgaacatgcagttatcattctgttgtcgctttccttcaacatatttttactttttctcttaatgcttaaattgagcctcctttcctgtccactggcttaaggaatacagatggcttttaattttattacttaaatttccttccatagttccctaaatgactcacccaactgttttcatttcttgcagtttactttctgatccatacattaaaacaaatcttaattcttaatgttactcagtctatctttatatttttatatcatttttacatacatttgaatgagctatcctattaaaattttaatattaactttgaaggtcttgttttgagattagcaatggtgtagagcgctgtgttggtatcaaaagtctctgatcaaccaactcattacctgtaggattttggatgagtcacaaagtttcttttcttctacccaaatgatagcaggtatttgaatagcttgcagttatactcaatataaagacataaaagtgaaattgctgttatttttagtatcactagtattaagagcaaacattcttgataattgtgtagaagtacaaaagcggctacattgaacacatatttgcactgttttatttctgtaccaacaaccttgcaatggcttccttttgttcttagaataataaaatccaagcgcccattatttggccttggtttaccttttcagccttcctttccacttactcttgagacattaagttttgtattcactgtccttcattcattatctattaatagctatgctttgctctctcagggccttcacacattctacagtcttagcctggcacacttctcctatttcatgtttcagattaaatggtgcaccttgggggaaactttcttaatcactctccattaagttaggtccccgtattgcatactttcagtgcactcagtaccttttctatgtagcacttttcacactgtttaaacatctgtttaaagactgtacacccactagatggaaaattgttgtaagatatacagacattgtcttgttaccaccacttgcctaacttctacaaactcaacaattatctgtggaaataaactaatacagatgaaatgaataattgtaaatttgctctgaaataagaagagaaagcactttaagtgttccttgagcatgataatctggaagaaattaggtatttgtagtcctctggatccacctctgacatgatatattttcttttttaccaccttgcaggaggtgtcttttccttgtatttttctggtatatgcaattcgggctcatttcacaaagtttaggaaaaaaagaaaaacataaataggatagtgaagcatgctatcatctagagcaaaaatcttttgaagtttgtgtgtaattattacaaaaggggaggggtaaactagtatgtgtacacttccgttaaatcgtgtaaatgaggactctaccaggaagaatcgctgctcgtagataaaagtgcattttatttccctagattgcatttatttaattcatataacatgagaaactcctccagtagcgtcaactagggttgataagaataatcgataaagcaaaataaaaacaccttctccaagattttgtaactgcaagcgaacgcatggtggcgctgttgactaagaaggcgaattaaaccacaggcattgtgcatgctcggtgacgcacggatccagtgtggtaaaccagcggttgagagcccaggcagatttttgagccagcaagtctgagcctctggaaaggcttattcactaggccgtctacaaaggttgtggggcaaaagactgtttcccagctctgtctgaggttcagcttggcgacattccctggaagagcgtgacggaaagtgcaatggaggcgggaggagagcgatttcttagacaaaggcaagtcttgcttctctttgtttttctgggagggtctctggctgggtccgagtcaagacgctattctgtggctgaggaaaaagagaagggctttttaatagccaacctagcaaaggatctgggactaagggtagaggaactggccgcgaggggggcccaagttgtgtccaaagggaacaaacagcattttcagctcagtcatcagacaggtgatttgctcctgaatgagaaattggaccgggaggagctatgcggccccacagaaccatgcatactacattttcagatattactgcaaaaccctttgcaattcgttacaaacgagctccgtatcatagatgtaaatgaccattctccggtattctttgaaaatgaaatgcatctgaaaatcctagaaagcactctgccaggaacagtaattcctttgggaaatgctgaggacttggatgtgggaagaaacagcctccaaaactacactatcactccgaattcccacttccacgtactcactcgcagtcgtagggacggaaggaagtacccggaactagtactggataaagcgctcgatcgggaggagcagccggaactcagcttaacgctcaccgcgctggacggcggctctccccctcggtctgggacagcccagataaacatccaggtcttagatataaacgacaatgcaccagaatttgcacagccgctctatgaggttgcagttctagagaatacccccgttaactctgtcattgtcactgtctcggcttctgacttagatacaggaagttttgggacaatatcatatgcattttttcatgcttctgaagaaattcgcaaaacttttcagctaaatccaattactggtgatatgcaactggtcaaatatttgaattttgaagcgattaatagttatgaagtcgacatcgaggccaaggatggcggaggcctatccggaaagtctacagtcatagtccaggtggttgatgtcaacgacaacccaccggaactgaccttgtcttcagtaaacagccctattcctgagaactcgggagagactgtactggctgttttcagtgtttctgatctagactctggagacaacggaagagtgatgtgttccattgagaacaatctccccttcttcctgaaaccatctgtagagaatttttacaccctagtgtcagaaggcgcgctggacagagagaccagatccgagtacaacattaccatcactatcactgacctggggacacccaggctgaaaaccaagtacaacataaccgtgctggtctccgacgtcaatgacaacgcccccgccttcacccaaatctcctacaccctgttcgtccgcgagaacaacagccccgccctgcacatcggcagtgtcagcgccacagacagagactcaggcaccaacgcccaggtaacctactcgctgctgccgccccaggacccgcacctgcccctctcttccctggtctccatcaacgcggacaacggccacctgtttgccctcaggtcgctggactacgaggccctgcaggcgttcgagttccgcgtgggcgccacagaccgtggctccccggctttgagcagcgaggcgctggtgcgcgtgctggtgctggacgccaacgacaactcgcccttcgtgctgtacccgctgcagaacggctccgcgccctgcaccgagctggtgccccgggcggctgagccgggctacctggtgaccaaggtggtggcggtggacggcgactcgggccagaacgcctggctgtcgtaccagctgctcaaggccacggagcccgggctgttcggcgtgtgggcgcacaatggcgaagtgcgcaccgccaggctgctgagcgagcgcgacgcggccaagcacaggctggtggtgctggtcaaggacaatggcgagcctccgcgctcggccaccgccacgctgcatgtgctcctggtggacggcttctcccagccctacctgcctctcccggaggcggcaccggcccaggcccaggccgacttgctcaccgtctacctggtggtggcattggcctcggtgtcttcgctcttcctcttttcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccaatacgaggtgtgtctgactggaggctccgggacaaatgagttcaagttcctgaagccaattatccccaacttcgttgctcagggtgcagagagggttagcgaggcaaatcccagtttcaggaagagctttgaattcagttaagtgttaataaggatctactgagcctcgtcttagttaatctgtggaaagtccttttttactgctttgtccattggagaggtcttttttggtctggttcaaggcaagtagcaagaatagagcaaaatatcaaatccagggatggcttaggtttcattaacagtactggaaagtagttgtgtggctctgaatgttttgtatttcaatcgagaatccttagtcgatagaacattttgtttatatattgattctactttttctgtagttaatccttgcatattctcctttcatcctggcttgccaacgcagtcttaattccgccttttttttttctaatggggagcaaaaagaaattcactgtcttttaatagtgatttcaaatagcttattaaaataactccattcaaattttacattataaagcaatgtagagagagttccaaaccaccaattttataatttcccttgttgaatatattcatataatgtgttctataatatgcccaaagcagctttgtctatagttaacaaagttttaaggatagacaagaatgtgttttctttaataaatagtaatatatcatctttttagggatatagtactcaaatgaaagtaatttagttcattttc

SEQ ID NO: 12484 - DNA, 12526 bp, Homo sapiens
aattttggagggctggggtagaatgctgtgaattgaatgtttgtgtctgatatggtttggctgcgccccaccgaaatctcaacttgaattatatctcccaggattcccacatgttgtgggagggacccggggggaggtaattgaatcatgggggccggtctttcccatcctattctcatgatagtgaataagtctcaagagatctgatgggtttatcaggcagtttctgcttttgcttcttcctcatttttctcttgctgacaccatataagaagtgcctttcgcctcctaccatgattctgaagcctccccagccatgtggaactgtaagtccagttaaacctctttttcttcccagtcgtgggtgtgtctttattagaagcatgaaaatggactaatacagtgtccctccaaaattattatggtgaaaccctaattgcccatgtgatggtagttggagacagggcctttcagaggtgattagatgagagtggaatcctcatgaagggattagtgcccttacaagacacatgagacagtgcgacctctctctctctctctctcaattcctctcagctctccaccatatgaggacacagcaagaaacaggctacttaaaaaccagaaagagggacctcactaagaactcaacaaggttggcaccctcgtctcggacttccagcctctagaactgtaagaataaatatttaagccactcattgtatgatatttttgttattagcccgaagtaagacaaagaagaaatattgctccaacaagatttatgagtatattttacagatctgcattggacaagttagctttccctgcaacgaccatttactgaatctttactatgtgccagaatctgagagtcatattagcatctgcaggtaaatcagccaaggttcaaagagatgactaaggccaggcacgatggcccatgcctgtaatcccagcactttgggagacccaggcaggaggatcgcctgagcagaggaattcgagactagcctgggcaacgtggtgaagcccttcctctacattaaaaaaaaaaaaaaaaaaaattagccaggtgtggtggcataagcctgtagtcccagctactcaggaggcagagatgggaggatcacttgagcccaggaggtcaaggttgcagtgaaccatcattgtgccactgaacaccagcctgggtgacagagcaataccctatctcaaaaaaagaaaagagagagagagatgaccagatttgcccagggacaccgagtgagttagtattcacactgggatttaaccccagatctgtatgactccaaagctggggctacctctattccactgggttgcgtctgcatatgtaaaaattagctgcattttaaatatttgtctaaaataaaccttaacctatcgcagggcgtgctgccccagcctgagactggctgcttcatctacagttgtttctctacttgtccttgcgtagggaagttttatcaccacaaggaccgtttctcctctgtttaatctaacacctgctagtctgagattctctaaatgtcccacaataaatatgaaaaacagtctcaggcatatttttcccctcttaaataatggagtctaaatgccaagtggccaaaagcaggcctttcagccattggcggctgaacactgtctgaacatgaaatccgtctcttcaaactatgtcaaaattgcttaataagaactcaggggaccccacattaatgaaaggatgcatctgctttgggtttcacattattgggagtgatggttcagagccagccacctatgcttgactttcactctttaaaactctgcagttaatcacagccctcattatacaaaggttacatggatataaagtttgaaagattcggttcaagactgcgagcggtggccaggaaaaaaaaaaaaaaggagaagacacaaagacaatgatcaaagaacaatgaataacattcaagactaagtcggtgcaaaattttcagaatgagaaatgaaacggaaaacttagaggataagtaccaagcacaagttttaggtattctggagacaggaaactcagaatattttagcaaccgattatgtctatgagggggatgaataatttattatctgataaagaatcttccctgagcctgtgacaagaaaggtcaaataggcaactgaagtagaacagtaaatacacgatatactactcgaaaaggaagtctggaacggaaggcgaaggaaagagcttccttggcccatgttcatcaactccctcagattacaagaagcgcagcggatgtactttttaggtaccctcatattaggaacccagaagtattcatacaaataaatgcaaataatgtatgagtacaatacttgtctaagtccttgaaaaaggccaatcttccggcatcacccacacaccagctgcaaatcttggatccaccccgttatctcccagctgtgtgagcctgggaaagtctatgcctcttccagcctctaaactgcctcatctgcacaatgggtttcacacataatataaatactttactgttaaatgctaagcacagtacctagtacaaagacaaataggaatatccaaccccccacctgcaggtgacaataataggacattttgcaaacgccccaaagaagaacttcagaactttacgttcctttgtgagcatgcgcttattgacttgagcaagtggcttatatagttcttgctggtttgcagacttgtttatatcatactttatttattgaaaatccaatactatacagaaaaacaatttgtaaagcaaagaaatgaggaacaaatctaatggctgatttaggatgcgctcttcccggtaatctacaactattaataatattaatagcttttatctttttgtttagctacagatcgttcagaacaatggagataagccctgtgacttgtgatgcgttgacgaatgatcatcttttccaagccaagtcaccagcttagacaggcatgaggctcgtattttacccgccccacataccacatgcctccccccaacacatatatcataaaagaaggccaaggccttccatccacaaaggcaaatcatgggacttaagcttttagtgtcaaaggagattgcatggaattcccacaaacagtgaagctataccagctcataaagtcactgaattttaaggagcctaaaagtaggtggagttttgcagaagtctttaaaagtgcgagcaatttactcctcagcatcctacccatcgttccttaatatcatgccatgaaaacacaggatgcggcagtttcccggcagggaaaacaacaacaacaacaaaatgaaaacacaagtgtcagtatctatgaaaagcacagcaaaatgttgagcccatgagcctaatataatggttggtactgagtgctccctatctgaaaataatgttaaagtcattatttccgatgcttatcaatgaggctgcaatcacataatgctgtcagtactatccctatcccttcactcccacaaaataaatagacccgatatcaactctattgaaaacctgaatcattacagcacttcagcagcaaaccgtgtggttgcaatcaactgagcatgcgctctctccctaaaacatgcacattccattacctctggctaataaatcttttatttttacccctcatctctctgctttctcaataatcattttgatataaaccattgcttgctgttcctgatgactaatcccttaatcatctttccaaaatatatgcagagtgtatttctttgtaaatacaaaagaaaaagcaatcacataaatagttaagatggcttttcaaatgacagttgagtgctaatatgagctacactggaaaatactaatcaacaaactaaatacacatccattaaaatgtaggagtccagacatatgaagacagaaaaagaattcattgcaactccactgaaatcaggctgataaacatctgccctagagctcctctttcagccagttggagaggttaagaaaagtaagcatcactttgcactttcatgcgtgaagaaaatattattattgttgttattaatagcagcagctaacatttaattgagcacttaatttattccacaatgggttaagactttatatacacagagttgatgtgtttaatagaaccacctgtatctctgaatagagatattatgatgtgcattttacagatgaagaaactgaggtttaaagaagttaagaaacttgcccaaggtcataagatgtatctgattctaatctttgccactataatacagcatgttttatagccgtggttatgaactggggacgatttgcacccccaagagacatctggcaatgcctggagacattttggttgccacaaacatacttgggtcacccctcccatatgagaggggaatagactcaagacacattctgggaagtcaggggtgagtcaaatagtaactctaagggagagccacctgcccctcttcccataccagccctctctgaccaacctgtggccatctcaatgtccagcagatgctgatgtttcacaacacttattgggcccctcgctatactaatggccagtccccaacagaagctcttctgcactctctgttaaacagatctagtgagggcctggcaggcatgaggaacattggttactcataacaatccctctcctctctctcaatccaccgcccctgcctcccagcctcagcctcatcccttttcctcctgcaaacaacgtagggagatggatgacatcaggtccatctgctcccactctaccctacctccttcttccacaggaccagagttttagatcccaagttccggggatctaaaatttagaaactaaaatttagaaatctaatagaaacagaagaaggaggaactcagagccccactggggtctttcaagagctctacactggaatgtcgaggtcttgctgtagctgttcatgaagtatgttttgatacctaataagctcttgttctttacatgcaatgcccctcagaggtcctgagatctcaagacagggagtgggatatgccagaccccgagaaataaagcaacagaagcccaactccaatagatactgggtaaaggaaagaataaaccatggtaatgcaggactcagacacacctatcgttgtcccagacttagagaactcacatggattcctaacacatagacactgctgctaaataaaagagagtccactgcatcttgaaaacaggaaaacatcttattccaccagccacactggcctcttggaatacacaggaaaacgataggtgcttgtcttaagaggtgagggcaccagtgtataattcacataaggatgtgaatgaggtagatcacatctgtgtgctgttccacaacataggaacaagccccactgccccgttttctttatttaaatatgaatgggggctgatgtgcctccatctcctccctctttttttaattatgccaaatggattggccttttaagacagtggtttacttctgtactgtccatgttatcctgttttaattgttttcattttttctcttctaactttggagcatctaaaacatctcagcaggagggcattttcccatgaaataattagtagtcatagtaattacatataggttcttaatatacttctatatggaatgtgttttcacttaagttgtattttattaaatagctccttcttcccaaaagtaatttgagagctctataaaggatatcttgaatataaagagacgacagggtagatcagagtggcttcctctaagaaataggatggatcctgaaattaatcactcaaaccgcagctagagagtttgaaagcaaaatctgcaaagtatgaacattgatactaaacatggtaaaaagatgggccatggggtggagcagacagacttggagtttggaagccagatggaccaagcaaggagcctgactctgagctcaccagctgtgcaattcgggtgagttccttcaccyttctgagccatcycttggctcgtctggaaaatgcaaaaaaaaaaaaaagaaaaacaccaggtttttgcatcctcctggatgagggatataaagtgcctgacacagcatatgacagggatttgataaatgggggctrttagctgtcccattgtggatgtgagaatagcattctgctggctaaaaggcagacatgaatgttctagaacatggcgatcccggaatgtgcagtgaaggcaggaagaggaagaatgggcagggaagaacaagttgggatggaggaatgaactcttatctccagaagcagagctaagaatgcccacggagccttggcacatgacagcctccgctgagccaaatggcccaaagacttctgaatgagcttttgctgcaacaaaaaactttggatcattttgagagcctcccgtgaggygccaatatgttgcagtaccttcccggccccgacactgatgtgattcatcgtaggtaacatatgaatacgctcaagctggccagcagcttgaaaaattggagtctatcaaattgaccttgagaaacacaggaaggtaatatttagtgacataccagatgaaatccttgcgcagagatgtgaggtgaggaaggacctgaagggaagtagaccagcaaatatcaagggtcaaggagttgggggatgatatagagacgaagcctaacagatgtcaccagagcaagaaggccttacgacttcacatcctctctgcagggtatgaatggtgcaatggaatgaaatggtaactacagcttctggtgcaaaatttgagtttccataatcatcatcttgggaaaatgaggaacacaatataatggcatacagagagaacaagtgaaaagatgagagatgatgaacaggttgagtttcttcagcctacaacctatcaaatctaattttaaacatctggagccacgtgtattagttttgtttctgttccattttcctttttctgtgtccccgacggtgaatgattctgaataattcttagtctgggatcactggtctatctcaaggtactacatgttagagtaaaactataaaacagcaaattctatcatctgaaattgactcacagggacccaattaaggctcaaaatataagaaagaaagactgaacagtgggtctttgacatcatccatccaacctttttccttaaagatgaggaaacaggctccaaatagatccagaggcttacccaaggtctcatcgctaattggggcaggtccaggaatttctgctctaagcatcaaacaataattaaaataggataaatgcagatgaatgtgttctcatatatattgtgttctcagaaaagaagaggataaatttaatgatgcaaaaacagttgtgctacagcattatcttccaagactggtttaaacatgaatgtcactgtacaatcaggttaccatagtgtcactagcgtccctggaattttacctttctagtttcaaatattacatcaaataggcagagttttacaattttgacacgccctcctgctagtcccaagaacactgcaagccctcagcagttgtctgtctacactgtcagtgggaatggaaattggagcaacaagataagaaatgactcgggaggtcgggcacggtggctcatgcctgtaatcccagcactttgggaggcctaggtgtgtagatcatgagatcaggaggtcgagactatcccagccaacatggtgaaactccgtctgtattaaaaatacaaaaattagctgggcatggtgacgcgtgcctgtagtcccggctactcgggaggctgaggcagaagaattgcttgaacgcaggaggtgaaagttgcagtgagtcgagattgtgccactgcactccagcctggtgacagagtgaaactcagtctcaaaaaaaaaataaaaaagaaaaagaaaaaaaagaaaaaagaaaatgactcgggaactgttaccaaaattttaaatgcatatgccctttgaatcaaggagtccagtgctaagattctgccccaggcatttactcacaaatacgtaaataaagaatgctcacagcagcatagtttaggcccaatatcagatgatatcgtaagaaagactgatgcaagaaagagagaactgtgaaacaccattgcttggaataacaaatagcaaaacaatgcaaacaacctaaatggccaccaaagggaagactggttatagcataagcacatgatggaatattatacagcagttaaaacaatgaagtagatctatatgcactaataagagatctcctgcagtactaagtttaaaaaaaaaaaaagtacagaacagaatgtgagtgtgtttgctggtatatagataacctttttctggaagaatacataatgtttatcttccaagagaaggaccaagaacgactttcacatttcatttttcaccttcccattctgcgtgtagattcaaataagatgcacgtattcccatttgtactcttctcaatacatccctaaaaattgctactatcccacctactagaggttactactttttaacattagtcagaaagacaataaaatgatcagaaaaagtaagactctgttttcttttttatttaacccaaaataataagctcagtgagctcaagataagggctcatttcaaatatactgaatttcaaatatttcatcataaatacactgaaaaagcagaaataaatcttccttttctttattttcactacttttcagtccagagtaccaaaaattttcttaagtacactgtagtctatttcttcaaatggcaagaaatctttcacagcattcaaaaatgaagacggcctccacagggtgtacccagcccccttcaggctctgctcccaaacacgctgctctatctcctcctccccctcctcccagggcctctgcacctgccattcccctaccccatctgacccttctccaccctcttcaggtctttcttcagatcttagttcaatcacttcttccttggggaccccaaaggtctcccaactccctggcatcattactgattcctaggaccactcactgctttttcaagtttacattaagatctgtgttttttgactaaatttgtcttccacaataggctgaaagctctacaaagacagtggcaacgtctgttgtccttaacagtagaccccagcacccatcacagaggtgcacttcatgaatatgtgaatgaatgaaaagtgaatgaatgcagtctggacttcattctgaaatccagcgatgtttcaaaaatcaaacagctcgcatcactctctagctcaaaccctctaatgtcttcctcaccgctatctcagagtctaccagatacccatcccccaacagcacctctcctacccactccattcatctccagccacactagcttccctgatgatccttgaaatctccaggcttgtgcctacctctgagccttagcatatgctcttctcactgctaagagaatacttctcttgacatctgcatggcttacccctacttcattcaggtctcagatcaaatgtcacaactttggaaggctccctgctgatgactccatcacactcacgctatcattccccccaccttcctctgctttacagtcctttatttactgacattatggcaaatattaaacttgattatggtctatttttcctacctagaaggtaagcctatgagggcagggattctgtttcgtttaatactatatccttggtcccaagactaatgcaagcccttagtaaatatttatgtagacacgtatcaacatcaacttctacatagacagagaaaagtaagaaatcagagatagggttaaagcttccttctttctaatcttaacaaccataagcataacagtctcctagttgcaatcatgggcgttcaccacgttttatttttcttaataaatgagttaaaggaagaaacattctcaaacccctgactaataaagcagatgacactgacaatgaactacaaacaaatgcgtgaataataatggacttgctcatgctttcattcataagacaaacaaagtgaagatgactttaaaaataaagacatgattccaagagcaataaactttacacactccactgaaatctccatatggttagcccggcatgtgtatttgacaattaaaaaaaacaacaacagtcaagcgcttacccattcttctaaaatgcgtgacactgcttcactcgcccttgccatgttcctgcaggccaagatcacatgtgcaccatggagggcaaaagacttggcggtttcgaaccctatggtttaaaggaaagtcaatgttagaaaacataacatcaacacagtgagtcatgttgaatggcctttaccggagcaccacttaaattaccccaagttctcaaccaggggtgattttgatccccaggggacagaagcaaatgtctggagacattttcagtggccacggttgtggggtagagtcctactggcatctagtgggtaaacaccaggcattacaaaacatcttaccatgaacagggcagcccctgacaacatagaaccatctggcccggactgtcaacactgtgatggtgagaaaacttgtcctagggatgcagtgatttcaaagatgaagactgggacatagaagagttcacggcatgtccagccatttaaccatcaataatgaccagatcctgtgcccacgataaggactttatgctctactctatggtaagtgtcgccagcacctctgcttctaccagtgttacctaggtttcttagccccatttcctactgagaacaattagaaaagatggacaaaataacacacgtgcatacacacccatatctgtttgaaggcatcagaagggcactatgactaagaattttgggggccaagatctgcaaaaactgcaaggccagcatttggcagcttttttccttcaaggcatatttcatttccaaacatagtggttggaagcctgagaagatgggctgagcttttggcaattttataacaaggaaaaagacataaatttgagctcaggacccaccaggaaagggccacggtaaacacaccaaacctttggtcgggatcctaaagagttataccctcgctgtaataacaagagacagtccagccttcacaagagtggaaactcagcttcaggccatttcaattcctagtttgattaaagtgatcagtccctatctatccaatttccagaagcaagagaaaatgttctctggaggaagataccattatctagagtctcaaattaccactatgattatttcaaatactcatataaactctcagacattcaaacaaaatagctaagcatacaaaaagaaaaaacttcaccaaaagccagaggggaacaaatggaaataaatgcacaggagatctgtctaatcaagttattcagaaacagtgattaaaataagtctgactgacaaattcaaggaacaaaaaggcaagatggagaattttgccagggaattagaaacaataaaaaaattcaaatagatattctgaaacttaaacaaaataagagtaataagagtaaagaagaattcagcatatagtttaacagaatacaagacacagctgacgacaagattgaggaaactacaaaataagttaacaaaaaaatccaaagtgaagcataaaaagaaaaaaataacacaataaaacaaagcacaaaagagacatatgaaacacattctcccaggctcttacacatacatgtaatctgagttccaaaacaagtgaaatagactaagaaaagcaatatttaaagacagaatggctgataatgttacaaaatcaatgacgcatacacggccaaaaaaagaagtatcctgagccataagcagaaatatgtatgtgtatgtgttgacatgtatatgtataaatgtgtgtgtctacatgtatgtgtgtgtgtgtatatatatatgtgcaagctacaagcagaaatgtacgtttgtatatatatatatatatttatgtctgtgtgagccgcaaacagaaatatatatgtgagtgtgtatctgtatgtgtgtatgtgtgtgtagatacacatatatacacatacatgtcaaagcaaggcacatcagagtaaaactgctaaaaactgcagatagttttagaagtagttagagaccagtagctacaagactgatagttatacctctcaggaaaatgatggaagccacagctgaaaaaaaataaaactttcatcttagaattctatacctagtgaaaatatttttgaaaaataaaggcagagaacaaaaattttaagcaaacgaaagctgctttttgtttgtcacctacactacacctagtgtcacgtatagacccacactagaggaaacactaaaggatgctcttcaggcaggaggaaaatgaccttagctataaacccagagatgcagaaagtaacaaagagcaacataaagggtaacgacatgttaagacccaa

SEQ ID NO: 12485 - DNA, 14867 bp, Homo sapiens
gccctcctcggcctcccaaagtgctgggattccaggcatgagccaccgtgtccggctccagtgacaatttttacaaagtgtgcacagttgaggggagagttctgaattctgttcatgtggtggaatactgtatgacttgcatatgtcatgctttttgaggggtggggagacagggtctcactctgttgcccaggctggagtgcagtggtgtgatgtcggcccacggcagcctctgcctcctaggctcaagcgatcctcccacctcagcctcctgcatagctgggaccacaggcatatgccacgtgcccagctaatttttttaaaatgtgtttttttctagagacagggtctcccagtattgctcaggctagtcttgaactcctgggctgaagtgaaccaccgcacccagcttgtgttgtgcttctgagtaatttttaatgatgtaagaaaatgatcacagtatagtaatcaataaaaaatgaaaaaaatacaaattatttgtacagtcttatctcaattatgtacatatacatgtagattcaaagaaaactcattgaaaggaaatacactaattcacaaaggttatctctaagtagtaagattatgggtgattttttttcttcttgagctgttatgtgttatttgtgtatttcctataatgaaaattctgagatcaaaacaatgattttctttgtgcaattggaaagtcaaaatagaaacagcaaaactaaagttatctttgattccttaatgttgcacaaaggaggggctttcagttgaaaaaaaaagacatgttctttccttaaaagaatccgctggccacgggtgcaggctgtgccaccagcactggatggtcctggcaccccagccagttgtgtagctggccccgctgtccaagcacaagccacatgcaagggctgagagaaagcttccctgccccctccctccatcacatcccccatgatactaatgtgggctcccttacctccgcagtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatcctcaaggggcgaagaggcggccgggagactgcagaagtggctccttttcataaactcccctaaaccacacacaggagagagcgacgggcctcggccctttgatgatagcacatggcgcaggacccttgtcctgggggctcaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcataaatatgcattgatttttgtacagacaaatggcacctctcttaatttataaattgaactggatgtgaactaataatgtgcaactagttgagataagagggttacagatcattgtacatggaaaatattcccagcagtaaacacttccattaatgtgatctacggcttttgaaaaggagcatctcagaataagatggtggtacaatttgcttattaaaattgagaaagaaaaaaaaagacacactggagtatattagaaaggaaaaagaaggaatgtggtctctcatgattgaaagcatgatttagatcggatacggcttttgctaaccaaggaccaagggactctggcaagatggggtggttttccgaatgccagaccgaggtgccttacgaaggcagctgccaatggttctgtggcacagactggctcctgagaacccagacgaccttgacctggcagcccggccctccacgctagtacctcgcctgattttccatcgttgcggtatccagccgcttcagacgtccgccgccttcagtggtggtagtcaaatgtagtcaaccaaaccacagcatcccttaggttaaaagcaaacggggcagctttgcctagagctcattgacagtgtgatggggggagaagggttgtcacaatggaagatgaggacactagactcatgtagcacagaaacatgaagccacacgcaccggcagcctccggggtgttcctcgctctctcgtatgttaaaccttatattttataagagtttttcctcttatttcactttttaaaaaaaattaaagtaggtggggaaaaaaataaagctttacacagaatttatatgtgggtaagtgtttcatggaaatttctaatcttaacgaagctaagtggagctcactcgtatccaaaagtataacaggtgcagaagccacaagtctgagaaccttgacgacagttccatcgtcctgccatttgatttttcagtctgcgtttcatcactgtgtagctattgtaaatgtgaatagaaaaaaacaggtcattgcctatttttgaagaacgcgttggtgttcgagtccactagacacactcgctccacacagccttcaccgtagactctgtagtggacacagatatagcataaatgaaattgttaaattatttcattgtagttaattcccactataggaatgctttatcatagtgaagtttcttttgagaagaaacggaactccttgaggcttctctttgggatgtatatgagcgtgtacatattattctatgtgtttataatataatattttcccaaatgacttcttgtttcactttgccttccacaacctgaatgccagattggttttttcccttcctggcccccagcacaagctgccatgactccccctcagaaaacacagcccctcctctaccattctcagtgatgtccatctgctccactccgcagccactttctagggcccaagttttggtagcagaaggaaaggcagtttttgagggtctttcgaaaaaaagaagacggggcagctttgcccagagctcgttggcagtctgtttgtatttcagtgtctaaccagaagtcctttctttgcggaccgcactctcgttcccactttcaagctaattaccaccaaggctgggagaggcaaggactgggggcggagctaggaataactcgtttgagaagggggtggagttttcgttgttcatttccatgttcagttctgtgacgtgacgatgacagatcaccactgcaggatccccctcacctttcctgttcagaattaaaactctcccttgatgagaaacagccagctgagggaggcccacgagcggcctgtgtaaccccatgggtgatctggacacatctgcacccccgcgttcagcttcgcggagactgaacttggcggggagtggaggggtgtggtgcagacctggctgcagcagaaacaccccgcagggacagtactctgtgattctgacctcaggtgctgggacgggcagatggtttgccccgcccagcaccccagtcctggtccctggtccctctctctgtttcatcccaggaaatgagcagctcgagggtgagcaagtgacaagttcctgagtcactggccccaaaaccaggtgcagtgtcctgtctcccaagtgtgtgcacaatgtatatatgcactggaaaggagggagaaggcagcgggtcactcgccaatcgcagggttctcagacacaggagagagcgggatcttaatgaattgcatttcctgcagagcctctagtgcacaggccagttctcggcagtggcttttcagcacaagggccttgcattgaagctccctcttctgagatttcacccagcctgatgaggcctgcatggttccggcctcgtcatccagtgtagataccagtcttcctatttttgtgacatctgcacatttggggtcattccctatatctgcataggagctattgctaaccttgttagggagaaacatggtctaatgagaaagacagacccctaggctcagctggccctgccatccttccagaggattcctctgcaactctaggcaagcacccagcttcctgggctctttttcctcatctgtgaaacttgcagggtgcagtgaggtttcaaaccagtgtgataagtgttggcctcacacctggcccaggggatgctgggagaacaggagcacttgttaataacagaaacactgatgggaccgaagccagtgcacacaccaggaaacctgcccgtggctgacactgtcctccagcctgcattctggggaggctgtgatgggcacgtttgccaaccccccccccccagtagagcccaggaccctcctctctcagcttgccagtgccctgccctccacatggcggggaacagcatcaatgaggtccttgctccctgagagcctctctggaacctgcccacttttctcaacatgtatattctgctttgtagtctgaggttgattttctagaggcgaggaaggggctgagttctgccctcgtgctgttcgctggtgctgatcagggccaagacgacccttccctctcccccacagcctgttgaggtgccgttgacgtggacagcgcccctcccttaagatgcccccttgccgttgccatgagccgctgtgactcacgcgtgcactgggccttgcttggtgctcccctcctcctcctgtctgagatcggagcttgctggagagcaccccaggtcgccgtgcttggctgcaggcccgtccctctctccccatcctcgggttcccagcgtgttttgtgcttgaacttggtggactcatcttaccccacaagagtggcctgctcaacctgcagcctccaatgtgccgtaggcgctccaggtccccgtggcgcccaggacaccaactctccctccctgcacttaggatgttctggaaatgaggggaaatccacattcctgccccaggaggtgggaagcctggcaacgatgtagcttcccctgagatgcggtatgatcaggcctcagcaactactcaggaggcaaaggtgtttggaaagcaaaccccaaacctcccggcacggcatgtgctctgcttccgtccctcaccgcctgcacaaggtcgttgagacttttctagaactccccggggttgtatttatggccttcaagcaaacaaattgaaaagcagtcaaggaggagttcagatagaaaagtgctggagatacacatctttccttcaaaggaaatgtaatttatttccaaccgctgcctcagacgggggtttcacatgttgtgaagtcacatcttgaatgactgtcaccctcatccttccccaaaaagctaaataagggcctttggcatcaatgcgtgcattctccacctttccgcggcttgcgcttggatttctgagtggctttcttcagggagcccttgtggtcatgtgtctttaatgctgctccccatgcccccaggccaggccagcacgctcaggtgatagcgagtggggccaggagacccccctgccctgcccagtggacagatctgccccagccctgctgtggggacgggccctctatcatttaaccacatacattaggttgcttttcagcaaaatgtcagctttcctcccattatgcaggagagagaaggggcgcaggtgtatctccttagagtacaccttggagctggatcactaagaaacagtcctcagactggtccttccgacacaggcagagagtgaactggatcgctggcccctgggatgctgcgctgtctgtgattagagagaagtggccagtgtcccgtctgtgattagacagaaacccctgtggcagactcctcccctctccatgaagaaagaaatatttacttagatattactgtttcaaaacacaaactttattccccttagagaagaaatactgcccttaaatagactgttgaaatattaatggcccccccatttaatcagtgtgtctgcggctttcttcgcgtcacatgtccgcattggcaggtgattctggaaagggattctgggaaaccaacaagtcttttttaaatctttgagttgtatgagaaagtatttaagttcaccagtgtagtaaacacccaccccagagcagcggtaagcaaacctaaatctgaaaacccattcttactgtctttcaccatgagatgctggttttggtgtaaaatgacagcacttggtttggggttttgcacctgttgggtagaactgttcttgtctgaggtcctcaccctctacagatgggcctcagggcctggaggtgggcagatggggccagagtggccagcagagacttgcatgggctctgaaagccccagagctcargcctaaggctgctaggtgagaccagcaggcagctgtggcatccgaccttgggacgcccaagctgggcagccgctccatgtgccccaaacaggatatcctcatgaatgtgaggagaggctggctcagggcttggttttcattttggcctggcacagggtacctgtagggagcactcccccaacctgaggatggtgaaaccatatgatagagactccttgtcgaagtccacatcggactgatctagaatgccccgtggggggattgcatggcctttgccttgagatgcaggtgaaagaaaggaaccaaacaaggcrtgagtgtgttggggaatcttcccagtggagcaaacccccttaacacaccagctgttgggaacagctgcccctaaatccaattaaaccctcatctccctggtgctgaacagtctacactggcccaggaagctaacgtctgagccgcttggagagctttggtaaacagaagacactggaagcccactcggtcagcagctgggcatgaggatgtcaggggcctttggacttgaggaaggacagtccaggtgcatggaatcctaatgggcctcatgcagacactggaagcagcccagccccctgcccaataccacagccctggggtgtcccctgacattcctggaggtccctgggcaaatgcatttcctgcctgggytctcagggtaggagaacagagaaggctccaagggtgttgggagtgagccaggggctggtctggggagtgggtctcacgcactgctcaggttggcacgagggacctcccccaycccaacccagccccaagggtcccagcagggctctcagcatggctgttttgagggtacacaggtggctggagaggggtggggcagttgcatggtgggtggcaaagtgtgcatttagaagctgcttcgtggcgttaagaacggggggagagggaccagcactgtaacgttagaaataattccttcttgcagacttgaaaagcatcagtttccctcccacggctgggtttttgtgtctgaaatacatctaattctccagactgcagcccctctcagccccgagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgcttccgtggagttgttgttttttgttttttgttttttttttttttggtggcgttggtcatttgtcacaactaattgtgtttctaagcccaggaaaggtaaatcagagagaaaaggggctctgtctgctgcgggcagggattgccccaggcccaggctgccccaggcccgagggactcagcacacgagttcacagacggaatgaagaaagagaccaggagtgtctcttctgacttcttcctttacaaggacagaaactccaagagaatgttctttgcccagccagggttgactgggcccagaacttccagatgcttctgtatctttgcactgtgccacactgccccaggtgtgtcgtaagaactattcccagcaggtggctagcagtagaaccatcccaggactctattattaagaccgttattatcattaatattactgtaatttttgcctacaaactacattatatcttcccctccaaaaaaaaaaaatgagaaaactgaccaggcctggtggttcacacctgtaattccagcactttgggaggccaaggcggttggatcacttgaggtcaggagttcaagaccagcctggccaacatggcgaaactccgtctctacttaaaatataaaaatcagctgggcatggtgggacatgcctgtaatcccagctactccggaggccgaggcaggagaatcacttgaacccaggaggcggaggttgcagcaagtcaagaccatgccactgcactccagtctgggcgacagaccaagactccatctcaaaaaaaaaaatgccaccactaattttgggaatgccttccagacagtcttctctgcaaatacaggggtgtcctcttccccctactcttccattcaagaaatagagaacctcgtgatctcatgacacattagtgacattttttgttgaagttttcccatggtgtgggagcccatagtgccacaaaatgcctcgtggacggccacaacatggaatgtgaggccacaggcagggcagcccctcacccagcacagagacctggtcacctgccgtcacaggacacccacaggcctcatgcacaagggtactgggctgacttgtcttctaagaaatgcggaagaagaaaaagcacaaggaaaggtgcttttaggaggaatcaatgccatttaagtgcatatagatggccgagcacggtggctcacgcctgtcatctcagtactttgggaggccgaggtgggcggatcacctgagaccggaagttccagaccagcctaggcaacatgccaaaaccccgtctctactaaaaatacaaaaaattagccaggcgtggtggcgcatgcctgtggtcccagctacttgagaggctgcggtgggaggattgcttgacgcaggaggtggaggtttcagtgagccgagatcatgccactgcactccaacctgggtgacagagcgagaccctgtctgaaaaaaaaaaatgcatattgcttatctgatgaatttaataacagatttacaaaacagcagcttaaataaatgaagggtttctttttcctcccaaaagaagaagcctggagagaggcaagcctgggctggccaacagctgcagagtctgctgggcccagcctcctcccggccgtctggtcaaccatggctcccaggtgcttgttacctctgggcacccccgagaggggcatctccagcatctgcattccagtgagaagaagagagaaggtgagagaagaggcagctgagtcggtccctcttaaccagcttccccagaagccaccctcatgcctccacttacacaccactgaccagactgggcggggtccctcagggctgcaagggatgctgggaaatggggggaggggtgatgtggaaggatggggagagcaggttttgaataggcggctcacgtccctgcccagccaccttgtttccccaccattcacacgcacccttcggtcagcacacagaacactccctccccaggagagacccgggggccaggccgtgcctgccctgctgctgctcagtggctcctcctctgtccatagcattgtccacacccagcttccctccagggctctaagtaaacctcagagtatctgtcaccctcctaggaggtgtcagggccccaggagtgggaaacggaatcaccttcccagaccaaggtacttaagccaggtgctctgggaagctctcaggtcacaaaagcaagactgaatgtttagatttcatagccaagacttgtattgtgatcacacgcagtgctggcaaggccaaggtgaggcgaacccaaacacgctgctggtggaagcagtgcccctgcaaagccatatggaattgtgcacaaagactctgaaaagcttccctcatgacccaggaaggcagaacctggaccacaccttcaccacgatagaggcttagtacgtgtttattgaccacatgaatgaattcaatgcccacgaatctggccaggggataatgggaatactttgacatgtgcctaaaaatgttcatgtctatggtatttatagtaacaatattggaagcaaggtcaaagcccaacagggagagagttaaataaatcatcgtgcatctgtaaaggggaggaagatttagtcatttcaaactgtgtttatcacatggggaaataatataaataaaaaattaggatataaaaaaagtatttacaggagtgatctctaattaaagatattttaatatccaggaaaaaatatacaaaatgttaacagtgctgtctttctctggggaatcctgggtggtttttatttctttcttttactttactgttcccattttctccattagcatgtacaggttgaatatctttaatctgaaacccaaaatactccaaaatacaaaactttttgagcaccaacatgattccgtaagtggaaaattccacatctgacctcgtgtggcaggttgcagtcaaaacttggtttcatgcacaaaattattgaaaatgttgcataaaattaccttcaggctatgtgtacaaggtatgtgtgaaacacgtgaattttgtatttagatttgggtcctctccccaagatatctcattgcaaatattgcaaaatctgaaaaaagtcaaaagccagatcacttctggtcccaaacattttggataaatgatgctcatcctgtattgtaaaaagttacattgaggcatatcttgaagctcacattttgccacagactttaaagaaagtgtttggggtttttttattaatatattgttctcatgctgaaattggaaaaaccattggttaactactttgatcctgaaaacaaattgattataagttaggaagcagcccaggcacggtggctcacacctgtaattcaaacactttaggaggctgaggcaagagaatcgcttgaggccgggagttcaagatcaggctgtgcaacataacaagaccccaagtctacaaaaaaaaattctttttttttttttttttttttttttgagacagggtctcacactgtcgcccaggctggtgtgtagtggcacaatctcagctcactgcaagctccgcctcccaggttcacgccattctcctgcctcagcctcccaagtagctgggactacaggcgcccaccaccgtgcctggctaattttctgtatttttaatagagacagggtttcaccatgttagccaggatggcctccatctcccgaccttgtgatccacccgcctcgacctcccaaagtgctgggattacaggcgtgaaccaccgcacctggccaaaaaatttttttaaattagccaggcgtggcatcgtacacctgtagtcggcttctcaggaggctgaggtgggaggatcgcttgagaccaggagtttgaggctgcagtgagctatgattgcaccactgcactccagcctgggcaacagagcgggaccctgtctctaataaagaaagaaagaaaaataaaaattttaaaaattaggaagcattgcaataaggagcaaaccaaactgtaagttacagaatctgaagaaataaagttcaaactgactcctgaccacagcatccgaacacagctgggaaccttccagaaggccaaccctgcctcctgctgccctcccagccccctcctctcccaccaggggaccatgctgactcctgaatgttctctccttgccttttcttgtccctcccggggatcggatcctgctcttcaccttttcctccacctgggaaggccctgctctctgtggcttcttccttgtcatctctggggtctctgatgaactgtcccttcctcaaagaggcctccacacctggcccctggctcctggccccatcaggcttccctgctcttgtgtttggcagtccttccccatggtgctcaccacaggcctttccttgtgggatcattcacctcccctgagctccaaggccatggatctgtgtgagttacacccagggcccagggaccagcctgaatgaatatccactgactcaactagtgaatgaaggaaggaacaagctctggcccatcaatggtcttgccttccttggcgcaattgagtgtcgagtgtccagctgcagcagcaattttctttgggtcaaaggaaaccaaacctcattataactgtgacaggagtgaggacaaaacatgggctgggggggatgcacccaagggaccctccttccaaattccagccaggcccgcccagttcccctggaaggcagggccagactcgctcagccctccctcctctgctgcccatggcacttcggtggaatctcagccatggcctgtgtctcaggggccgggtcccttgttgacctgcgggctctcccccagcctgggctcgcacagggctccccaccccaccctcgctacacccggacctgcccgtggtgacagcgaagatgacagtgcggctgtacaatggacaaaagcctggcagtccacgccagccgcgagtggggaggagttacgatcagccctactgtctccagcacgttccgagaagctactcagtcgcaatttatcaccactagagtccagtaaggctcctaattggcccataaatgtggtccaataaccgcgcctgacatccaaagacactgcaggcaattagcacttatttatttgcatatggtattgaccaatgcgctagctgcactcactttcaagatctgtttatttttaaagctggaggggaaaaaaagccctcatttactgcactacaaggggaactaccacacacacacacacacacacacacacacacacacacacacaccactagcagggatgatgggaacttggcatcgcactgcctctggctaaagggattcagtgattcacttgtgtgcagggtcctgtcaatatcttacaaagtactcaatagatgcaacctgtccaggtgactgtgccggcgcagccagcagcagccttcttgcccggaggaggctgaggggatggagcagcccgaggagatggagtagcccaggactgcaccccacttgtgtgggttttccaaatgtatggcaaattgcctttgccaaaccgcactcggctaggaccgcaggcacgtaccaccatgccagactaatttttggcagagatggggttccatcatgttacaccagctggtcttgaactcctgggctcaagcgatccatccgcctcggcctcccaaggtgctggaattataggtgtgagccaccacaccagcctgagattaaacttgattttaatttgttatttctgcttatttgaattacttgtctgaaaaattattatttctataactatttttaaaagaaggaaacaaaatgaaatgaacaatgaccaaccacccagagacaggcgatcttagggtgtggatatgtgttctggcattctggcatcttttttaaaatatacatgtacttttttttttttgacggagtttcgctcttcttgcccaggctggtgtgcagtggcacaatctcggctcactgca

SEQ ID NO: 12486 - DNA, 22320 bp, Homo sapiens
agaatcttgctccatcacccagtggattctcctgcctcagcctcccaagtagctgggattacaggcgcataccaccacacccagctaatttttaaaattttttagtagaaatggggtttcaccacgttggccattctggtctccagcttctggtctaaagtgatccacccacctcagcctcccgaattgctgggattacaggcgtgagccaccgagtctggcctcttacacttccaatgaaccccatagcttgtagcacattgctttgtgtggtaagtgtctctattcatggtcctagcaggaaatgaatagcacagtgaaattaggataatttgggggagagtttaataaagtgataattacaaagaagtaggcagggtgtagggaaatcagaaagaatagtgcagtgccttagtacccacagctctgttgtgatcacctccaagctcaaaaagatgaggacagagcagtcgtgtagagaggactttctttttttttttttcttttctttttttttttttttttttttgagatggagtcttgctctgtcgcccaggctggagtgcagtggcgcgatctcggctcactgcaagctctgcctcccgggttcacgccattcttctgcctcagcctcctgagcagctgtgactacaagcgcccgccaccgcgcccggctaattttttttgtatttttagtagagacggggtttcaccgtggtctcgatctcctgacctcgtgatccacccgcctcggcctcccaaactgctgggattacaggcgtgagccaccgcgcccggcgagaggactttctcaataaaaactgtgactttcattgataccgtccatttgggacaacttactgaagcagaaagcagggtggagactgaattcaagggaaaacataagatgtctggtacagcatacaacagcattgattcagaggagggtgggagtactgagcccaggagacggagaaggaatgtaaagcctgcgagaggctgctcagcaattatctggtcccttagcctacaggattagcagcttcctaactcaggcaattatctctctggacctgtttcttctatctataagttgatggaattagtctaatgatatctaaggtccctactatgtgtacgtctactgtgacaaggtccttagctgcatgatctttaattctgacaaaggttactatcacaaatattttaacatgtttattctcgtggttactaatcaacaatctctggcactattacaacaaacctttcagtatttacagagaagttatttgccattcttagcaactggccagtcaacaactcaactttatagtaagttacagaatttattctgtatattgtattctgtacaatgtattccatacattaatttattttgtggtaaaacagtaacttttcattttagatgggaaaactagacgagctgagattcaacccacgtgagcggctgcagagccgctacccttaacagctctctctcgggattctaacattcccttctgtgacggagagacagcaggccgggacacgcatcccaggacggatccacagctggatggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccgggtgagcgggagggatcgaggatgaactgggaggaggaaggtggagccgtaggagagggattgagggcggggcttggaaacaaatgacaggggaagtccaagagagggaactcgaaccttgaaagcggccgagaagctacaggggagggagacctgagttctaaattaggaactcaaggattagagttttggagaggcgggagagtgaggactgagggagccgaaaagggcggtgaccggagtattctaagtaaagtgttttgtagagaggactgttgagaggagagtgttaaaaagaaggagcatttggagaaccgaagtaagaggggcaatccagcgtggcctctccagccatgctttttgcaactgcctaacatgtgttgttctataaatcctcttccccaggtttgcaggaggcctagggaagagggcagaaactagggatggaaaagtgagatgggcacagcctagagaggaagcattaaggctcttgaaagcagtaagggacatggcctggggatccaagaggagatgagggtgggggaaacattctgccactgtttcgatcttttgtctctttttccctcaacttcctgtagatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcaggtatgaggccctggccttgcaggtatgaaatcctggcagttgagtccccaagggagaccaagtgtgggaggggtgccgtggattggaggggcaaaatatgggttcaggaggagaattgaggaactaatctcagcttccattcctccacagcacatatcctactttttatcaagaagggtgtacttgtccttccctaagcacaagatatgcttctcacctctgcaactttgtttatgtcctgcttgagatcccttctcttcagtcctaccctttcttcaaaaccacttccctaggtctgaagagaaggccttgtctgtcttttcactgggtggttggcacaggctactactttgcgtagctatcaggtcaccccatctattctataagttctcagggtagagacaggccatccttacatctttgggacctcacccagcacgcaccctccacatggtgaatatttggtggtgatgcttaggagagaggtgggggagagttgcaggctagcctgtggtgggggcagatctgggtctgggtctcccaaggtcgggcagactaggccactgggatacccagccccttatccttccacagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtgaggctccgagatccctacctatgacctctgacccgttttagaactcctcgttccctttcaagggtttccctcctcccatgctcttctactgtctccctgcttctccctcgtggcccttccctttgactttccctcgtaagggcagcaagcatgggcctcctgggcctggggaaggtacatggatcagaagtcaggatcagggatccaagtctcagaaggggggttcctgggcctgagttctagaagggtggtgcctggaagaggaggaaagaagtgcccaagatgagaaaagggcttgactccatttctaagctcttctccctctcttaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacatatggcatgcagtctgtcagtgtctcccaagctacagggctgagtttgggaaagaaagccagagggagcctgggagcaccgaactggagtctgggcagccaccacgccctctggcaaccgctggggttcggccacccccgcagacccgcccccactttgccagagcggccgggtccccattcccattccttcaaatcccctttttcccggcagccgacctgtagacccaagggagacaggttgaagctagaaagagtcggggcagcagctctggtaggggagggagcatccaaaacctctggcttctgagcgcctctcctgccgcccatccacaaagccccccacagcctggcggctgccctcgaccccgcaaaacaaaggacttcagaggctggacctacagacccagatgagaaggcaaaagcgtagggaggagcggcaggagatgggaagggcgggccccgctcggagcagctgccgcttcctcccaaagtcccacgaggggcctgagtcacgggccaccgccctgggtcggcgagctgggggaagggatctggacacctggcgtgtccgggcgggaagctggtgagggcccctggggacagagcggaggaccagtggttggggcgagaagagggcagtcccgcagcgagtcccacgcggggtgggagggatctaggccccgccctctcctcggctccgccctgcgcccccttccctctcctcattgtccttagacaaagcggtcgccgcccccgcccggccccctggtctctgtctccgtccctcctcctttgctgcctctttccctcctcctctccctccctcctcccctccctccagtctccggatctccctcggtccctctctcctcctcttcctctctctggacgcccggctcctccgcaccccctcccccgggggtcccgcggcctgtgagttgactgaggggctcagacttggggagtgggtgtctcctcgcccctgtccttgctcccgtccctggcccggaccttggctgtctcctctttgtgccgagattgtcagtctgtgcggctacagcggggtggagacggccggctctgtcacggcttcatgagagcggggacggggcgcaggacttgcaggcgccggggagaagagacatggagccggcccttggcactctggggtcgcgtggggcagtcggtgggggaggcaggcggtggtgacaggacagggtgggggtggacgccagggttctgggaacgcgctggcagccctgacgcccgggttccgaaagtctcgggggtgggtatttcccccgacccgcctcgggggcggagtgcggggcagaggggtgggggctggggagaggcgtggcccgagcggtgctggaagcggagccgggacctttggggcccgcgctgagacgcgcccggctgctgccgccgccctcctttcccctcttccctggtttcccttctcctctagacctgttcgctctccgcccctccttgcctccccaacaccccctcaggtcccgttgcctcctggtcctttcagggattcctggtccttccttcccacactagcctccctggggtatcgctgaggcagcctggcctgcacccaggttcccctcacccctgccacatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcrggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagargtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttcygcaggagtggaggcagcagagcagaggcctgtggaagatggcgagaggggcatgaagccaacagaagggtggaaatggaccctgaactccgggaaggctcgagaatggacacccagggacatagaggctcaaactcagaaacyagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacaggtagggaagcagccaagccagacttcttagaagtccacttgtcaattttctctggactctggtctctttcttttttatacccctgttttcttgtcttcctctattctttcttgttaattcctgccaccacccttcctcgctctgcacatacacccttccttctcagagccctccttttccattttgagcccaaaagatcctgccccagcaaaggctgtctctgggtgtgtctctttcagggtgtgccaggctgctcattctcccttcccttgggctctgagtttccaacccccttttctttccttcctttcctgagtgtgacctgccccagcccatccagtgggagagcctaaagtgacgagcttgaatcagtgagggcagggtcaccagggtgagagcacttgcagtttttctggggagaagggatagggagcctggggtggtggagggggtggggtgggtttgtgttctagggagaaactgcagggagaagtgaatggagaaaggtccaactgccccgtgggaaggagggcagagctgaatagggacatcctaggatggaggggagaggggagatggaaccgggccggccaaagagcagagagaaggcttttgaaccccgagtctgccccatgggagagacacagagaggccatttgaagtgggtgacctcggggttgcacacccccagctgggccactgcttcagacagtgctcccttctctcttgggacaagaaaagccttctcctcttccaaaatacccccgcccctcactcccctgtccttcctccctgggtttcccctccctcccaagaactggctcagggatcggttttcccctcttttcctgccatcctggactttccctccccttagggtagcaaaagagagaagtgaatttggagacagttttgagaacaggcactggccagggagcacagtgggagttctggacaggggttggggctgaggccagcagagggtcagaggttagacttgcaacaaagacctgcaggaaagtgggggcagccaggatgactccccctggccctggcctcacttcttccctgtgcacatccatctgtttccagcttgaaaatctctagggagacagaggtcccacactcagacatctcagacttaggaagtccctccagtcacacacatctccccagagcctgggaagcccagtctcattctcatcccatgtgttaacatcctcagatttgatttttttgtgtcctcagtgtcagtggggaaccacagggactaaagatacgggttaagccttgggtggaggggggttcatttgatcccccaattcatcttcacatgaagcgtaagctcccacctctaagccatggttcttgggaacctaccctcagccctctgactgctaccagcctgttcccctcagggctgggcagatgaaaaaaacagaagtccggaaatgctacccgggtgaggtgttcagaaaagtcacttcctactgagagaggcttgtgcctctggggaagaatgagcagagggaagcatgaagctttggggcccaaagcccagggagcatcccaggggagccaggaagcaagtgcagggcaggacctgtgctggtgaccatacctaggccagagagcaggggagccggaagcagatcgcccaaacaggaagcctggggtgggggccggaaggctggtggggctgagtggggaaccctgggccctgggccctgggcctgccagatctgtgctcaggatgtggtgagagaataaggaagcagccgctgcttgggtgggggtggggaggaggcagcacagagttcctctgacccagacgcctcaccctccaccctctaccccctgtcagcamcctgttcttcagggactgggtgccttgtcccagctctgctgcaacacactggctcaggaataggagataggaggaccctgccaccaacccccgcttcaccttccctaaataactcgtttgcaggctaattccatcaaatttatccctgccatcaggagagaaatcccagccctgccactggagcccaggggatggctgtggctggtgccctaccccagaggcctcttggttgggctgagagaccagccccattgtgaccttatatagctgatgggagaggagcgagtgagtcaccccctctctacccccccactcccatgcaggctgtgcatttctgagaagcccagtcagaagttggtggggggtgaggagacaggcagggtaggsggggagatataaacatagrccgagagcaaataaaataagtcattttcagagtagaaaataaagtacagaggttattattccaaaagaggatatgagaagaaaacaaaaatgggttcccagaaatgtgggtaaatctgtcagttacagaaacctaagcggtcccttctgagaacttgggatataagcagtctggctgctgtcactagattctaccagcagttccacagacatgaactgggggtcaaatgtgtacaggctggaccacccgcagatcgtttccccagcattggtcctctgatggcacctcatgtgaggtctgaacaaaccctaacctcttgcattgtaccaacttctaagctcctttcttttttcttttcttttcttttttttttctgagacagtctcgctgtctcccagcctggagttcaatggtgagatttcggctcactgcaacctccacctcccgggttcaagtgattctccagcctcagcctcctgagtagctggaattacaggcgcacgccaccatacccggctaattttagtatttttagtagagacggggtttcaccatgttagccaggctggtctcgaactcctgacctcaagtgatccacctgtcttggcctcccaaagtgctgggattacaggggtgagccaccttacccggccccaagctcctttcaacagcagacatgagtataatatattagtaaattatctagtaagttagaaggtggtaagtgattatggaaaaaaaaatagaacagtggaacttagagggtcaggaggtagggggagtgaatatggagacttcaaaatagggtgatcaggagggtcagagccatggggatattttgggggagtgttccaggcagaaggaatagctagtactgttctggtcctgaggtaggagtgcgtggagggaaccaaggccagtgtggctggagtggaggaagaggccagagaggcaaggggagggtggcatactgggagcaccctgtaggctttggtcaggctctgggcaccttgggggcaatcaagtagacttttttttttttttttttttgagacagagtcttgctctgttgcccaagccgtagagcagtggcgcgacctcggctcactgcaacctccgcctcccgggttcaagcaattctcctgcctcgtcctctcgagtagctgggactacaggtgcacgccaccatgcccagctaatttttttgtatttttagtagagacaggtttcaccatgttggccaggatggtctcaatctcttgaccttgtgatccgcccgcctcggcctcccaaagttctgggattataggcatgaaccaccgcgcccagcctggagtagactttttgctccaagtgagatggggagacactgcagggttcagagccaacaaggagtaacatatacagttcctgagttctaccttcccatggggacccaggtgtcatatctggttttctttttttttcttttttagagacagtgtcactctattgcccaggctggtctcgaactcctgggctcaagaaatcctcccgcctcaacctcccaaagtgctggggctacaggtgtgagccaccatgcctgactggtgtcatattgatgcagctcttaacaaccacctgcccagccacccttctggcttctctcttttcatacctcagttcattaggggactcagggatgtacggctgaccccaagtcttcccaaacagatgccagggaaggcctgagtagatcatttggacctttccaagtagttcatatggaatcctcctgctgtctccctaatccctttggctcctagacttaatcccaccctgccccttccccctgagcttcttaatagggcaaaggggaagggtagaaaggcagtgagaacagctgggactcgcctgctcttgggacagtgtgattaccaagggttttctgtgccctgtctggtattttgtctctgtgcctgtccctttgggcacactgtggacccccaccccaggtttgtgtggactttcctttctgcccttgtcatctcccccagccttcagggtgtcagyggctcatctttcccctgtgtgttgctggagtctcttggttcctctcggcctttctgttcatctcccatctcttcctaggccctagactccctttgctatggataggagaggaatgaggagagtaggagggaacaggtgcccagggtcctgggttttgcataggacagcaaggggctgtgggtatgaaaaccttgcttttgtctgagactcgctccccagccagttctttccccactggccagtctgctgggctcctctgggaagttcactcgattgcccccaaggtgcccaaagactcggttctgatcacaagacttatcgccatgtattttaatttctttttacccctctgcctcccacactcgaaatagcagggaccttggtcttatattattcacttctgcctcccaagcccctgccaacgtacagggcaaagtctgatgttttgaaatgatatgatcgaagagggaaactctagaattggagagccagtatggaaaggaaaactggatcccagagtggatggggagagtgagtggggcacctgagtccagcccccacccccacgttccgccagtcccacctgctcccttgcagactccgccccccccgcccccgctttctctccctcaacccccgcgggcttctcccctgctgaccttgcctcctgccccctttttctccctccttcagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctsctgcagccagagctccagggcgggctgcgcaccaaggccctgattgtgggtaagcggaggctccgccggcccgagggcgccccctgctgtcagagcgggcgctgtggtccaggagagaggagggaggattacatgtaggcactcggaaggggcttggcgggtcctctggttcaacatgctcctttaacagatgggcaaactgaggtccccggcagtgaagtacacattgagtcttcaggtttcaaaacgagaactcttcctgagtgctgtaatctggtcaaaatcacagggtgggtcgacaggcctgagttggaattccagcttgtctctttaattgtgtgatctcagggaaaccatctgatctcttgctttagtttattatttatgaaatgaagttaataataactacctcctgtggctcatgcctgtaatcccagcacttcgggaagccaagacgggtggatcgcttgagcccaggagttcaagaccaccctgggcaacatggcaaaatcctgtctctacaaaaaaattgaaaaattatccaggtgtgggccgggcacggtggctcacgcctgtgatcccagcactttgggaggccgaggcgggcggatcacgaagtcaggagatcgagaccatcctggctaacacggtgaaaccccatctctactaaaaatacaaaaaaaaattagctgggcgtggtggcgggcacctgtagtcccaactacttgggaggctgaggcaggagaatggcgtgaacctgggaggcggagcttgcagtgagccgaggtcgtgccactgcactccagccttgacaacagagtgagactccgtctcaaaaaaaaaaaaaaaaattagccaggtgtggcagtgcgcagctgtggttccaggtacttggaaggctgaggtgggagcatcgtttgacctcaggagttggaggctgcagtgaaccaatattgcaccacccactgcactccagcctgggcaacaaaggaagacctgtctcaaaagaaacaaacaggccaggcacggtggctcacgcctgtaatctcagcactttgggaggccgaggcaggtggatcactcaaggtcagaagttcaagaccagcctggccaacatagtgaaaacccatctctactaaaaatacaaaaattagctaggcatggaggtggacacctgtaatccctgctactcgggagtctgaggcaggagaatcacttgaacccgggaagcagaggttgcagtgagccgagatgacgccactacactccagcctgggtgacagagtgaaattctgtctcaaaaaaacagaaaccaaaaactacctcctagacttgtagaaaatattaagtaattttatttatttatttatttatttattttgagacagcgtctccctctgtcgcctggactggaatgcagtggcacaaccttggctcactgcaacctctgcctcccaagttcaagcgattcttgtgcctcagcctctctagtagctgggattacagatgtgtaccatcacacctggctagtttttatatttttagtagagacagggtttccccatgttggtcaggctggtcttgaactcctgacctcaagtgatcctcctgcctcagcctcccaaattgcttggattacaggtgctccaggccaagattaagtaattttttgtgaagcaccaagagccacagctggatatcatattacttaatctctcctggagttatggtgagattaaacagttataaggatgcctggcacagagtccgagctaaatgagtgatggatgtggttactggtggtaacatgctttagatatggragatattataggacttcctgcatgccaactgcccttcaatttgtgtgggggggaagggtgrgcagaaggcagaggctctcactcattctctaacattattgccccctctcccacagatgagtcctgccggcrgtgaccatcttccaacatagggatatacctccctccttcttataactgaagatcctggagcccggaagattcagggcagacagaccctgataatgagcctggcagggaagggcaaccaacwtcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccaccygccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaamtcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaactcgtctgcttctccttctttgggaaaaaaaaagggtatgtgaggggaggctctggtggctgggggagaggaaaatgatgggggatgaaccaggaactcggcactgacatgtcaaaaggggtctgggaagctgcacgtgggtttcacgcaggacaagcaggtgacatgagaaagggcagttgaagtgtccactagactggaagtgccatgagggctgactacatcagctggattcactgcaatatcctgtacctgtcaactagtagacacggaattatttctagaatgaatgacaacaaatgaatgaatagaagaaaagggttaaaatattacagaggacactttgagttgaagggttctagtattcagaagcctgctgccatgaaggcagctaggtagtgtatgacacaacccatgtggctaatccagggatacttacttaaagagctggggctacgaatactaaatctgaaattgctgcaaaatgaagtaagtatgtacaagagtcagtttcctggaaaaggttcccctctgatagacaatggattttatatcgttaaaggcctaaaggccgggcacggtggctcacgcctgtgatcccagcactttgggaggccgaggcaggcggatcataaggtcaggagattgagaccatcctggctaacacggtgaaaccccgtctctactaaaaatacaaaaaattagcggggcatagtggtgggcacctgtagtcccagctactcgggaggctgaggcaggagaatggcatgaacccgggaggtggagcttgcagtgagctgagattgcgccattacactccagcctgggcagcagagtgagactccatctcaaaaaaaaaaaaaaaggtttaaaaaccatcttgatagtgcatggctttggtgcccatgtagttgatatttggaattttcccatttcaaagaatatcttatacaaatgtggaacatcaatattttactcatcaggaaaatttgtttgtttgttgttagctctccaggctaacaaagatatggttgaatagttatagtccttctaccactacaagttgctcctctcagactggtcagaggaggccccacacctttactataaaacaaaatatatgagacaaattgaacttaagcatacgccaaaggttttcaatttactagcaagagaacaagccaggtgtcaaaagactcagccagttcagagaaggtctgggtagggaaggaaacagaatgattatattagtagcctgttaggtaaaggtcttaaaaagtttccagttgtgacccaggaaaacagagttaggaagctccgaggtgccaggggtgctcacagtccatctcagaaacagaaaacaatgcattcaagaggtcaggccaggtgtggtggctcatgcctgtaatcctaacactttgggatgccaaggcgggtggactgcctcatctgaggagtttgagaccagcctgggcaacatgatgaaaccccgtctctactaaaatacaaaaaattagctggacgtggtggcacgcacctgtagtcccgcctactcaggaggctgaggcaggagaattgcttgaacccaggaggtggaggctgcagtgagccaagatcacgccactgcattccagcctgggcgacagagtgagactccgagactccctttccaaaaaaaaaaaaaaaaaagtcagtgatgtagatccacttgtggctattaataagaacaatgtttcatttcctaacagtagtgcctggtaactgcaattaatcacaaaagtatgatgcaggatcaaacaaatcagacagcagagcatcgagtaacaaattcagctttttgttttgtttgtttttttttttttgagcatagtcttggtctgttgcctaggttggagtgcctgacctcggctcactgcaacctctggctcctgggctcaagagattctcctgtctcaggcccagtgcggtggctcacgcctgtaatcccagcactttgggaggccgagacgggcggatcatgaggtcaggagtttgagaccagcctgaccaacatggtaaaaccccatctgtattaaaaatacaaaaactagctgggcgtgatggcatgtgcttgtcacacttgtaattccagctactcaggaggctgaggcaggagaatcacttgaacctgggaggcggaagttgcagtgagccgagatcgtgccattgcactccagtctgggcaacagagcgagactctgtctccaaaaaaaaaaaaaaaattctcctgtctcagtctccagagtagctgggactacaggtgcacacctccacacctggctaattttttgtagagatggtggggtctcaccctgttgcccaggctggtctcaaacccctggtctcaagatatcctcctgcctcagcctcccaaagtgctgggattacagcaagagccactgcacctggccttgcttacttttaaataagcagccaccagtgattttctcaagctgttaagcaaaaatgcagaacacagtttgcctgttccttagtttggagattttgtctttaacaactttccccagttccccagtttcttcctgcctagaggtcttcccttatacctgacctgtcttcactcctgctgcaggcaaaccagtcctagcaacggtcacttttttgtttgtttgagacagagacttcctctgttgctcaggctggagtgccgtggtgggatctcggctcactgcaaactctgcttcccatgttcaaatgattctcctgcctcagcctcccgagtggctgggactacaggcgcacaccaccacgccaggctaatttttatatttttagtagagacagggtttcgccatcttggccaggctggtctcgaactcctgacctcagataatccgcccgccttggcctcccaaagtgctgggattacaggcatgagccaccgcgcccggccaacaatgctaatatgttttatgagcatggacccgatcttccaatctgaaatagaatttcattcctcccttactttgtatagtttttggctctataaaatttccatactttctttattatgtatcctgtccctcccccaccgcaaaatgtaaatttggtaaggaacttttgatttgtcctctgctatatcccagggacggaaagcaatgagcacacattaggcatccattaaattaatttcacttgttgaatgaatgcgtgagcgaagcactcacagactgaccatcagggggcgtcagagaaactggacagaggcgaaatgaagaaaaaagaattaccccgagttttcaggtatggttccgcgaggtttgaactcgctcggccaccgtagtgcttagaggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtgtcggcaggggtggggaggggccctgtgatttgtcccggtgaggctggcctaacggtccatcgagaagttaagaaagctcagttcacaagcacttattctttgtccgttgtcgcgtaggtactgtgctagctgctggacgcccagctcagtggagaagattgaggagggcttaggtgtgtcgggttaagcgcaatagaacggtgtttctcgaactcttaacatgcatccaaggttcttgttaaaatgcagattgcgattcagtagggatcttagtttctgcatttctttctttcttttttttttttttgagagacacagtctcgctcgccccgtcgcccaggctggagtgcggtcgtaagatcacggctcactacagcgtcgacctccctggttgaagcgaccctcccacctcatcttccccggtagctgggactacgggcgcgcgccaccacccccggctaatatcttttatttttatttttatttttagagatgaggccttggtgtgttgcgcaggctggtctctaactcctcagctcaagcaatcctctctcagccccctcagagtgctgagattacaggcgtgagccaccatgcccggcccccctcatcttctgaacttcctttcagtcgtttaattaacagagggggccgggtgcagtggctcacacctgtaatcccagcaccccgggaggctgaggcaggaggattacttgagcccaggagttcgagaccagcctgggcaacatggcgaaaccttcgtcctacaaaaaaattaaaaattagttgagcgtggtagtgtgcacctgtgtttctagctacttaggagcctgaggtgggaggatcccttgagcccaagagggacagagtgaaaccctgtctgtaaaaaaaaataaaaaaccccattcaggatgatgaagatggggtgaagccatgaggaagaaagagaatgaatgctggttagctggtttaaaactaagtaattgtgcccgggtgcggtggctcatgcctgtaatcccagcactttgggaggctgaggtgagtggatcatgaggtcaggagtttgagaccagcctggccaacatggtgaaacctcatctctactaaaaatacaaaaatagtcgggcgtggtggcatgtgcctgtaatctcagctacttgggaggctgaggcaggagaattgcttgaacctgggaggcggaggttgaagtgagccgagatcacgccattgcctgacagtggggccgggccgcgggggcaggaaagactaagtaattgcttaaattaggaacagagctaagtgggagggcagagatcaggagttgctcagacctccttatcttcccctctactgacaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacagggtaagtcagaagcagggtgagagaggatggggcaggctgaagtgttctctatgcccttatttaatcccctggatgggctgcagggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggtgaataggagcagcatgttctgtaaatccccaagatcccagggtgaaatctgaggttggctgtgagtgcagagatagtgatctctgggaagacaaggggctgtctctagtgagatgttcacctctgtggtgagagaagccctgtgcatcctgtggctaagacaactgtctgctgtacctgcaatcagagagattcctcactgagaggggacattttttgtgttagggcgcatctgaatgatccttgtgattctagaggggagcagctgtcagtgtgggggctctttggcctcacacccctccattcttgttttttcttctaggcttatgaagaggctcagaagcgcctcaagatggccgaggaagaccggaaggccatggtgagtcccagggcctagggag

SEQ ID NO: 12487 - DNA, 47941 bp, Homo sapiens
cagttctcctgcttcagcttcccgagtagctgggatttcaggtgcgtgccaccatacctggctaatttttgtattttagtaaagacggagtttcaccatgttggccaggctggtctcgaactcctgacctcaagtaatccacctgcctcggcctccaaaagtgctggaattacaggcatgagccaccatgtccagccagaatacattgtataagaaaattgatttcaattataatgtacctgtggtacttaactaccaaggattgggaaccgtttgaccataatttttccatctgttggataagagctgaatcagaatgtcattctaagctaatagtggctatcatccatgacctaaaacggactcttgttaggggactgaagattggcaaagggagaagctagaggccatatagaagaggaaagcatgaaggtagaaaccacaatcaggactgccttcaaatatgaacttccagggatacttcttggttctgggtagctcccccaccacactgttttcttttgctgtcctcaggaatcagcttgcttgtttcgtttcattgctatcatctgtagtttctaatgagtttttcactttctgtgatctctacagaacagattttacttttctctcttctcccctacatttgtgtctgtgaagtatgcatgctggtgtttttactacttttaaggaaagagaagtatttagaaacaaaaacgtatttcatctgtctttgccacaaggattttttcctccctagttacattttcacgggaaaaacaagttgtacataagtgcatcttacatttcagaggaaagtcagactggagttatagtggacttcttatcattagttaggtagaggtagaggcagcagcctggtcttaacaggactctgcctctgtagggagggatgaggaaactaaagactacaggagtcaactgcactggggtactgggttacaggaaggctagtgatcttgctaacctagaagactagaaagtagaggaaattcatatgcccttttcctgagtttgaaaaggctttgttctttcatctcacagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtacatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtctcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatagcaagatcctgctctcttaagaaaaaaaaaaaaaaagaaaagaaaaggaaagaataattgtttacttcaaatatttatgaaaaaaactctgaaatttttttaaatcaggaaataaggtaaatgaaatgatttttcaacttttgattatgaaatgtccaaacagaaaacttgcaaaaatgaacacccatatacttataacttatagtcaacatctaattgtaactttttcatgcctggttttagaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgaaatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtagtgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaagggcgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggkgtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggtgagcggcatgtgcagtcagttagggctctagagcagattaaaagggtactccagagtggagtctgggaagttgttccctctgcaacgttcgggggcgcatgtcccatctctagggagagcacgggggtcgaagcgggcttttgcggagcaccctccagatgttggacagttttagtgctatgttcgttttgttgcagagattaagtctccctacggttattcctatacacagcaaactcaattatttgtagaaaaatgaagaaggaagaaaggaagtagtcactctacctctaactgaagagatggataaattatagttcgttcaactgtacaggctttagtttgccgctgtagatgctgtatgtttatggttgtttcttagactttttcatttaaaagcttccagtgtctggttacgtcttgtaacaccatgatgactgtgatggtgcttatgtccctggacctccagggacataagcacaacactgatgggccatgctcctccctccttactgttgctgttcaagttggggacaggagtggtgtgggagctgttgctctcttgttgagctcgcttagcttttccttcagcctaattaccacaagttccttttgatacagactagtaagagaggccagtttgtggagaaattgggataatggtgtattcaaaaagagcgtcaactttttgcttgtttccactatccctcaaaactgatatttctactttcaaatccatcctgaatcctagaaaaagagcaattttaatggtatatcttagcagatggagctctacataagaaattacagattagtccagatttccttccagtttaaaagcattgtctttctgacagtaaaaccagagaaaggacatttcaargaatgactcaaagaattagtaatgaacctcaaacagttcatctttccttgttattatgacyttgcaaatgtgtttatattttcaagaccggtagctaagttctatgaatttacaaggtgcaaaataggactttgttttctttgctccccaaatgcctcctttttataatttccagggcttgctttcatagttttcacattccaggatttggttaacaagcccttatgctatttatttgtatagtcttgtcacccttcatcttttcatgctaattttttgtttttatatagaaattttatgttcccagtattttaattaccttgtagatagatcgaaagaattataagcctcagaaattttctctttacttcaaagtttgcattgtctttttttcaacctggtgattaaatgtattatatattttgatttggctcttgttatgtactattaatgtacctctactgaaagccattagaattttttaaacaaatatttctcagaaggttaaagaccgaggagaatcctttgaaccttagagcagtgctggagacccagaggtacggttggttgagcttatgaaacaaggtgtaacattggcagtttaatttgatctttttccctttttaggtgtggaggtattttaagcagttgttcattatgagcaattcatattagtgaggctttagtaggtcagcagcatgagcaagagtgagtatttattatagcattttagatttggaaagataatttttctttttataattttgtcaaattgaaacatctttttgcaggggaggagctttactaactagccccagtggaccaggctatcatatcatgttgcctttcattactacgttcagatctgtgcaggtgagtgattcctaggggaagcctccataccagatagacaggcatgacaggagttaccacacttgtgggtggagatagatttccttattgcttaagcagatggtggtatttacttaaatgcagaagttaacgttcagagtacagttgttacaacacaagttatgatgttaaaccacctcacttacttgaaatgaattaaaggtatgaaccaggaagcttggaaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttctgcctcatgtttttttgcctggtatattaagcacaattttatgtggaaccttagtgaatgttatattttgatggcatcccgggatatttgaaataagtgtctaatcctcgaaaagtgtcttggccatgggagacaataaaataagtatctttcaatgtaacaagatgacaaaaccaggattaggctgtgaccactttcgcaagcccagtgtgatcataaatctttggattcagaagtttgtctgccatctgctgctaatttttcaggactcaggaaaattctgtgttatttaatcttgtaatcttatgtctaggcttcctgctaagtgagagtttaattataaattcttaaatcccctaggttttcttcctgtccccttttasatggcttagggaaagaattgtgtctactgaagtgaaatgtattcttcccctaatcagactgatttccatatgttgttccatatttattttacccattctttccttagttcatgccatcacttctttatctgccatctcactctccattccttytctcctgtctaaatcttgccaggcttttaaaggctcatcccagattcttcctcttctgatctatagctcttaaagtctatattgtaaattttggccctttgtcttattttctttaatattgttgtcttgcattgtttgctaagtttttttatgtgttttctttccagaaaggctccagttttcttaaaggcaggagttgtaacacatttatatttctggctttctatttatggtggaagttgttaaattgagctgatttctcaggaagcaatgtggtgtaatgaacatggggacccagcgttaccgccagttggtggcatgactttggaaaaattgcttaactgtcatagacttcagttagtcttctgtgaaaggaggaattttaattacataacctcatcaacagccgaaacaatctataataatgttagcaatggcagcattagacccttaaaaatcaagactctaaggcccggcgcagtggctcatgcctgtaatccgagcactttgggaggctgaagcaggtggatcacttgagcctaggagtttgagaccagcctgggcaacatggggaaactccgtctcttaaaaaaaaaaaaaaaaaaaaatcaaggctctaacaaatagatcttgttcaaaaccaggtagatctgtctctgccttcatgcttagtatgttaagtcatactgatgcaaaaatataaataaaggagatatagataatagtaaacagattttggagtttaattgtgtatatatataacaaatatagtgtgtgtatatatttaataataaactatcataagagatgtaaatgaaattagtacagagacttcagtgtaaactaaaatacttcgcatctacaaaaaagttttacatgggctagagccagccagtgtgactaaataggaatgttctttatgtgtaaaacggtaacattctaggaaataattatattaataaaaccatatttaaaaagtgttcttggccgggcgtggcggctcacgcctgtaatcccagcactttgggaggccgaggcaggcagatcacttgaggtcaggagttcaagaccagcctggccaacctggtcaaacgctgtgtctacaaaaatacaaaaattagctgggcgtggttgtgcgtgcctgtaatcccagctatttgggaggctgaggcaggagaatcgcttgaacctgggagaccgaggttgcagtgagccgagatcgtacccttgcactccagcctgggcaacagaggaagactccgtctcaaaaaaaaaaaaaaaaaaagagtgttcttaagagagtaagacataaatttatttttaggaatttttggaacatattagaagacatagtccagataaacaaatggtttaacaaacttggcaattgaaaggaatgtatataaatgtgaaattccatatatgatgtaaaaagaaaaagcaatggagaaattatatgaaaaccttcagccttcataaagtaaccatagattcactttttaaataaattttctgtcatactgggaaagtaatttttaagaggacataaaagaaatataaaagtacataaagatagggtgttaaatggaagatttaacatttgaaccctttcctagttcttctgagtttgaaaattggctagagaatatccttttggtttaaataggaacgtgtatttaaagttggtgtggaatatggaaactgaattaatgttataaaggaaataaatataatttgtctcttcatcaatccccttaacctagaactgccaccaatgtttactgtcattctaatgtctcaacctaagagttattttttattctttcccctcctggaattttatatcaaccaagtatcagatacctcctctattatgtctggattgacagctttcatggcctttactgaattaatctaaataaattaattatttagcctcccagctggttttcttacctccctataagatggagaatgagaactacatcacatgtgagaaaaggaattaagtaaacatatttttgaatggttcgttttgtgactgtatataaggtgaactagagagatcccaaactccccagccagcattcagggccctctgtctagtattaccatggtctcttgtcagaatttcatctttcatccaaattgtcccttstgctccaggcaagcctatctactttcgttcgcctatacacatgttgtcttcaactgtgtgtatttcagtaggatatttattgagcttaagatgttcctctgcctcatctgttcttatttctcccactctagacctggcttataaatccttcacctcagagagcttttcaaactactatttttttcactttctgtaatttaccacttaacagttcagtttataatttgtgtttttggttttgttttgttttgttttgtacctgttgatggattgattgcattgtaacattttgtctcctgtgctggattgtgaactctttggaaacagggactgtgattcctttttcctttgctttgtgcttgataagatgcagtatgtctagaatgtactcattaggtgctgacctatttgaggccttagagtacagcaggaagtcattcattctggatctgaacaaaggtgtgacaagggcaaagcaattaagtaccagattgttggttcaccaggaggaagcagtactggtggtagcacttctattaaaaaggaaactgaataggacatgtgagagatcactaggtattaaactaaaatgttgaccacagctttagagaagaaaggttgctgttggattcaagggcagctttgagtcttagagtacttgtatgcataaaatctcttttatcttcaacataaatagtaatattagcagtggaatcaaagttcagagtgcaagttgtagccagagtatctatgtgagcaagctgtgttgtttacaacccctggccagctccaggcaggtaagggactctggaagagttttctacttattagcagactgaacattgaacctttcccagtgaatcttaattcaaacattcgctgtaggccaggcacagtggctcacgcctgtaatcccagcactttgggaggccaaggtgggtggatcacttgaggccaggagttcaagaccagcctggccaacatggtgaaacctcatctttactaaaaatacaaaaattagctgagcgtagtggtgcatacctgtaatcccagctacttgggaggctggggcacaagaaccgcctgaacccaggaggcagaggttgcagtgagccaagattgcaccactgcattccagcctgggtgacaaagcaagactctgtctccaaaaaaaaaaaaaaattgctgtaaaatattttctgtctcaagtctttcatttctactagaatacaaaaagaaatgactgttctgagagctaatctttgggaactgaaattgtgatggatctctgctgtacttactgtcagcagctttccagagatttgcctctggtaccagtagttttttgacaatgtgtgtcttgagtgttgatgagatatcttttcctccctagacaacactacaaactgatgaagttaaaaatgtgccttgtggaacaaggtaagctttctctttgcctacgagcctccctttagctcagacagagtttctgttcctacagctatgatcacttagacatatctcarataggcatgatagttaacccaaggggacttctgatctgagcattgtttgagcaaaggcctatctccaaataggagcttttccatcttaagaaccattattgttcttatggtattattggaaaaaactggagttttagagcaagtagacctaactgtgyattagcactgctgcatctgctttattgactattttttaaagactttattttttacagcagttttaggttcatagtgaaattsascaaaaagtacagacagtttttatatacctctttccccaacacattcctttattgacactttaaagcttagtttcctcctttataaaggcagtaaaatctaccttgcagagttgttgtaaggattagaattactgtatatgaagtgcctaaccagaacttggcccagaataggtgcttaataaaacatagtttaaaattaatcatcccaccgtcttctcatctgtagtgttaaatgccatctaatttagagtttctgattcaataggtctggggtgaggcccgagaatttgcatttctaacaaaagttcctgggtgatgctgatactgctggtctgaagacctcactttgagaattgctgtcctaaagaggtttagggaaagaaaggcaagcagggcccaaattatttctagggtataatcactgcattgaattgtatcaaaagaagaatgtgaagttcaaggtattttttaaattacttattttaaatgactattwcaagtgtaaaaaagacattgacatctatagagggacagaaatgctatgaaaaaggaagcgaactctttctgtgttttaagtgaatattagtatgtttcattatcagcttctcyccaggtctatctataactgtgttttatggattgcctttagtagttcacactytttttctttgtttttagtggtggggtcatgatctatattgaccgaatagaagtggttaatatgttggctccttatgcaggtatgttacccatctacctgtggtttttatagttatagccagaggatttatagctgagagattctttgaggaatagaagggtactttgaaagttttatgacttcattgatcactgattaataaatttctggggaatagaggcaaaaataggtcagaagttctggacagagttgactttctgcaactgtatgagttactcttctctgagcttagtgtttctaagagcaaaatggtcattggttatttctagaataggaaagtagtattttatccagtcaggatgagagataatttccttgggtgttagaaatctgtaactgatcaattccttggcccacactgatttgccatcaaagagaagtattttctagttgagatttgctataatttgcaaagcagtctgaaagccttcaacgtggggaaagcattttcttgataaaagatgaaaacctacaggtatggggtgggtaggtactgttgtaatcaaaaacttaattagaagccctgaagaaagatataccgtcttatatgcatgcttgttaataaaactggcatgtctagtatgtacagaatattgtgtttggcaagaataatttgaaaagatgaaattacagcctttgccttcaggggttttaattttacttgagaagacataatacagagctaaaaaaggatatattgggatgtaaggtcataataaatttcacataaccggtacaggcacaaatagtgaaaagatttcagagtagagagcaggcgtattactgtcaagggcatttggattatatttttcagagagtaagcattttccttgtctttttttcctctcctttccttgattacaaatcactggaatggattatgattgaaaaagggaagggactgatgattctttaaccagagattaaataggaaactatttagatataattcatttgggaaatgatcaagcaaatgatttagtcattaagtatttattaatggcctgtccattaattttttttcttttttgagatggagtcttgttctgtcacccaggctggagtgcagtggcatgatctcagctcagtgcaacctctgccttttgggttcatgcaattctcctgcctcascctccctagtagctgggactacaggtgtatgcctccacaccaggctaatttttgtatttttagtagagacagtgtttcaccatgttggccaggctggtcttgaactcctgactcaaatgatccacccacctcagcctcccaaagtgctgggattacaggcatgagccaccgcgcccagtcggatttgaaatccagttgcatctaatatcccacatgggaaggccagtggagcaaattcttggatctgaagacagaagtagaaagcagcatgtttttgtagataaagaacaggttctgacgtggtctagtatgtaccttttgggcatttctaaaattctctgtttcttagtttcctaatatgcaaatttaggagaattcagtgctaatttatgtaaattacctgatataaagcccagctcagttaatgttttaacaactttaaaaaattgcctttttaaaaacggtcttttgcaactgctttcttcttttatttctactgttcctcagtttgcctagtctctctttacctcttagctaaacttttgcagtaattgccttatgctttccctgcctctgatctttatgcttctcagttcatcttcacactgctggccaaagcgtaaatctgactgtcatgcccttgcttgaaacctttgatagttccttattacctccaaaataatggatactttagtgtggactttaaagttagcccctgtttgatgggctaaccagcaggtgtttggcattagtattacaaatgcaagggtatttggaaaattgagcacaagcaacacatcaagatttgttagttgtggtttttggtttcactattttgttggcacttttcctcatgtgtaatatatcaccctgacttttaccctggctgaatttgaaggtacctgtgtcattgttgggtaaaacaaacatgggttgtacctctccttcagtgtttgatatcgtgaggaactatactgcagattatgacaagaccttaatcttcaataaaatccaccatgagctgaaccagttctgcagtgcccacacacttcaggaagtttacattgaattgtttggtaagtgtcttaattcttatgtatgtaaatagccaattggaaatctttgttcagcttacttattgaggttatattggtaaaccttagtgctatttaagcatttcttctgaatttatcatagagcaattgtctttaaaatattttttatcttaagtttaaaattttttatataacttgttagagattggaaaaactactcagactgtattctgtttttactgtaataacttagtgaaaattagctttgttgatgttttaatagataatttgaaaaatttagaaacctgtgtcttgaggctcccatttttgatgatttggtaggagactgacaggactcagcacatagttgtgttcacagctaagatttattacagccaaagggtacaaagcaaaatcagcgagaggcaaaggcacaccagcaaaatgcagaggaaagcaggtgcaggcttccaagagtcaaacatgtgcctaattcccacagcaacaagctgtgacaacacatgtgaaatgttgtctactagggaagctcattggagactcattgcccagggttttcactgggggctgattatgtaggcaccctctgcctaccacataaaaattccagactcctggaaggaatgcaggtgtttggcataagccacattgtataaacagttcacagcaagtcaattgtattagctctggggatagtgggacccttctacaaatccaagttcctaggtgccaaccaaggacgagtttacaaaaggcctttctaaggattgcagtatcagccctgctttcttaactcacttctgtacaacttacttttcatttatgatagtggaagttctgaccagggaatgagttgttgctgttggtagctcacttttccctcctgaaatttttagtgaatttctaagatgaaggaataagcaagagtaatcaatttaaaatctaccaattgagtcctctttggtgattgtcaaccactgaagtggcatgtgaggaaactgatgggtcctgctttgtctcaccaccagtcatttaaatagcgaaagtaccattgaggtgaatagaaagtgcatagttacaagcccaagtgttcatgctgtgtatatttcaaatacttttctatgagcttctctctctgtctctctctctctctctctttaaatccaaaataacagtgaggctgagatccatggaaatgaagtttagttatttgggaatttgagtaaagatttactgaacatagaaatttgtttttctttgagaatgaggatacatattgagtaagagccctgaattaagatactagagatccagattctccatttattagatcaacatattttacccagtagttgtttatccagtaaataagtctaataagttacccagtaaaaaagcttatccatagttaagtaatacatttagtgggtaaacttattggataaacagactatctgcttgtcatcttcrttccttaatttctttattagataattccttgcaatttttttcccacacaaaagggaagaaaaggcagtttaagctctgtaaaagaatagtactgtggaaactttaggtctaataatgattagttttgtttcattatgaatacaatgtaaaaaaaattgactatcatgagatctgttgttcttggcttaaaaaacagatcaaatagatgaaaacctgaagcaagctctgcagaaagacttaaacctcatggccccaggtctcactatacaggtaagttcttttcctagggaagttctctggggattttgagagctttgagtttgttcctcctttcattggattgttttattcagcaattatttgagatgctatggtgatttatagaatacctttctcaatttgactttagatctctgccaaaataaaatactcttgtagcttrctatgggtgacatttgtgaactcctagagggaactgataagctgaggctcttacaaggaagtaaaattcatatttctgccatgtatgaagcattaagatacagtaatggttataaatcagtgtaagcataatccctgccctcagtaagattatgaaaagggagttcaagtgtaaaatttgaacaatcctggacaaaatagttatcacaaagtattaattgacagatgaatctattgaatgattattgctgtaagagtaagagaacattggaagacagtgtgtctaggagagggctgtgattgagttgagattttaagtaggtttggaaaaattaattggatttaaatgggggaagaatgagaaaggtatttcaagtgggagggacagccctagtaaaaacaaggtagcaggtgaatttagtggtagtggtgatggtgacgttgggaaatagaatggtgagaggttttacccctgcttttttttgggtcactgtgttttccagattgtgggttgtaaaatcaactttagtgagtcatgaacagcattttaaataaaatggaatagaataggaaaagaaatggyatgtaataagtttaaatattctgtgacacttgtgtttcacagtgtggcggggtaggtgtttatattggacgtcagtgcaaaatgtgtttcttactgtgtccactgtcagtaacattcgaaagccactgctctggatccagatgacctaagaagttatattgaggcttctctagtgtcctttctcaggagctctaggagaccagttgattgttgattgttgtgatgaacattactgcaactaaagcttatcacatgtctctcaattctttacactcagcaccactgctactgagagtgtgcgctcactgtgattgtatgtgttcgtgcttctcaaaaacaagactgaaagataggtggggttttcctcatggcctcattcatgcaatgtcattatctcaggcgcttgagggtgagccaccagagttaaggggtcgtttgaaatgtccagaggtaactttgtaaaatcctctgagttgttcaagtcagttgtagctggagtagctttttagttttaaagatagtgaatgtgaaggtcagctcttagattctgcccagggtgttactcagagatctagctcattcaactgttgtttagaattccttgccttatattacttagccatttttctgttcccagttttttgctattaaacaatagtgtaatgaacattcatgacacatgttcttgtatgtacaaattatctttcaaactgactgtacaaatgtacattcttaacagcaatatgtgcaaataattgtgacccatgaactcaccaacattggaagcaatcagacatactgattgttaccatatggatgggtgggcaattatatctccctttgatttgcattcctttggttgttaatgaggttgaacatcttttgatacatttattggtcatttatactgtcttctgctgattgcctattcatatcttttgcccatttttctgttggattgttttctttcttactgatttgttctgtataaatttggaatttttatacacacacgttatttatgttgtagaaaaaagttagatactaggaaaatgatgaagaataaaatgaaattcaccagtaatcttattatgcagggataacatcatttgttatatctttctcgactattcttaatgtatatgaacaaatgtttgtagatataaatgcatacatgctcaactaaagcagaatcataccatacttgcttttttcactaacattgtctatgaacatctttccaaaacaaaaatataggtttggtaaatcattacttttaatggttatatttagtgaatctctatggtttcaaattttttactactgtatgcatgttggaatgaccaagcttatatattctgtacatctttttaaatccctctcttacaataaattcttgaagtgggattgatgatcaaagtgtatgccctgtttgggggcttattgatacatactaccgaatcaccttttagaaaaattttagcagctccccccctcattagcagtgttggtaagctgtagttcttacacatttgattgcatgattgtacccaaataattagcagatgcaagctttccctttctctcttaatccttttggagaaaattagtctgttattttgtgttaattattgaagttgaataccctaggttattagctgtttttatttcatttataaattgttggttttgctcatttttgtagttaatggtttttctaactgattttaataagctatttttggctgggcatagcggctcacatctgtaatcccaccactttaggaggctgaggtggaaagctcccttgagcccaggagtttgaggtcagcttggacaacatagtgagaccccttctccacaaaaaatttttttaaaaaattaggtaggtgtggtggcatgtgcctgtagtcccagctacttgggaggctgaggtgggaggatgacttgaacacagcaggttgaggctgcagtgaactgtgttcatgctgtactcttgtctgggcaacagagcaaaacccwgtctataaataaataaataaatagcatttgtatatagagaacttgtttttgaaccttaccctttgagaggggtagaattcgtttttaaaaataaactttttcatatgttagttattgtagctcttttttatatttataggaaacattttcttcaaattttttctttgtcatttaactttgttttttccttgctgataactttgaagtgttcatgttttacatagtaatttcagtgattttgtctttatrgtgtgttgctgagctggcatgttttaagagcttttcaccaccttaaaagtatagcaattaaaattagaaattataaaaattgtatctgcttttacagttgtattcttagatttaaatcttttaattcatctgcaacccattttgatctcagttgcaaggtaggccttcagctccatcccctcaaccccaaattgggtaacagcggtaattactgaatagtttatttttccatcttcccccttctttgaaatagtttttatgttacatactgcattccattatatactagagtctttttctgaacttagttctgttccattgatcttcccattcctactctttcattagttattgagtccttggtcttttctcatcaaatcgaattttctcctgtgtttttcatcttgtcagttaatggtaactctttcccctcaagccartctagaagtgtaggaggcatctttgacaatcgcctcaccctcagcatctaatcagtccctatgtcctgcagattccaccaccaaaatccaygtattaataaaactgaccacacctccatcttcactgtcatctcaagccaagctaccaactctaaccttgacatgtgcagtagcagtagccgcctgtcttctttccccactttcacttttacctttgtctacttcattttctgcacaacagccagaaggatcttttgaatttacttatatttatttgctgtttttataaaaagttattgattgaaaaaatgtagttttgttatacgttcttaaagtggtagagatctccattgttttagggtttaaaaaaattttaaaataatttttatattttgcaataacttaagcataccctgagaagagaagagctcctttgctttggttgcttttgtcttgttataaaattttttttacaatagttggaatgcattttaagaatttcaaggctgtttttgagctttgttatttttaacacattaccatatggttgtgataattcaactttttattttaaaatctggcaagagacatcatcttttaaaaaataatggcctttgctgtttctgccagcttaatcttccagatgagttttcattatcgatattttcaagctatatcaggcacctaagtggtcatatacatgttgttttgttttgttttgttttgagacagggtctccctctgttgcccaggctggagtgcagtggcatgatcataggtcactgcagccttgaactcctgggctcaagtgattctcctgccttagcctcccaagtagctaggagtacaggtacacacccccacatctggctaatttttttattttttgtagagatgggcctttgccgtgttgcccaggctggtctcaaactcctggcctcatgcaatcctccaatataagttaaaaatagaaacatagtttatggctttactttatcatatcagcctttttggtttttagaatttctgatttaggggagaaactcatatcctaagttaaattaataccaatggatttaatgaattttaatgctgttcaatatgtagtcttttttttttttaatcattgaggaatgtgattgattcttggtagatttatcttatatctacaacttgaattcactgccttctagtaatttttgggttactatttttacagtcactattatatttttttcctttccatatatttatataccatttttcttcttgaaaaactactctggcaaattagaatgatgaaaatggtcatctttgattttttttttcctatgttatttaagggagtgactatattatagactggcttttgatatataatatatgcttaaaacccaggggtcagtttcaatacatatattcctttcattagccatttttttcctccattcactctatgtatgtgagtgggatgggggcattattttattatttgaggttaagagcagaggtttaataggcaaaagaaacagaaaggagaatagctctctctcctgtgagggagaggggtgcctgagtgggacttcccacttttacttttaaaatctcttttgatgcaacttactcatggtatctgtacagtaagtgtttatgttttcacatatttgaaaatctgtgagatttcccaagattggcaagcacaatgtagtatgttcttcagcctcattcagcaaaataggagtcttcaaaagacagtcctggccgagtgtggtggctcacgcctgtaatcccagcactttgggaggccgaggtggttggatcacctgagttcaggagttcgagaccagcttgaccaacacagtgaaaccctgtctctactaaaaaacaatacaaaaattagtcgggcttggtggcgcatgcctgtaatcccagcaactaaggaggctgaggcagaagaatcgcttgaacctgggaggcggaggttgcagtgaactgagattgcaccaccgcactccagcctgggtaacaagagcaaaactccatctcaaaaaaaaaaaaaaaagtcctactttacgcttcttttaataaggctaaaaagatatgtggccagtctcttaattaaatgcagtatgacagtgcttccttgaatcatattaatccatattggaagtaatcttatgtctgctagtcacatggtgaaatctgacatctcacaaaatctggtcctgaatttttatttgtcttctgcatgtctccactgagttgtgaggcctcacatgtgtcactgccagtgtgttgtgagttttttccacacagccttcagctgcttattccattccactgtaatccttatatttagttatgattgtcctcaaaattacctacaaatttgactcatctatttcatataggaaatgctatatcgcttaaaagttttaaaagcctttaaagaagactaagtgcttaaaggctttgttattcttaaaaggttagccagttttcagaaggaaaacttcttcagaccagcaaagtgttttttgtgtgtgtttgcagtataggtggggcggcggggtatcgtatgtttagtaaaatcaaaagcttttgagagatcaagtccttgatgtagaaaagtcagccttcaaaaaacagtactgtccaggtagataatcttaattgtgtcaaagaacactatgattagggaaacaaagtgtctggtaaacagcctctacaaagacagactttgttctaagtgagagttaaggaagaaagaatataagcttttaattgatatttgttttccttcagccagtgggctgtttacttacagcaaataccaagtgattgcaggggttggaagtgatagattaatttactcactactcactgtattaaattgtatacaccaacctgggtttttttgtttgtttttgtatttgactaattgtttctgactttacaatttcagtcttggaactttgccttcccggcttctttggtttacagggttgaaaaagaaagcaaaagtatctaacgacctttgtaaaacatcttttaagtgagaacctttttcataaggcagttgtttcctcagtgggtagatggtttttcctgtaatctggcattgtgtaaggaaataagaagcagcttgtctttgattcttggtgtgatggcatgaaaagtaaatgttctggtgggatccccaaacgtgttagtaggccgctatattatagctgttgtttattagattagtatcatttgaggggcttttctgtagaagatttaatttgaagatttatctttcaaatatactttggctttttcacttttattttttaggctgtgcgtgttacaaaacccaaaatcccagaagccataagaagaaattttgagttaatgtgagtaatatgcatgggatcccaatatttctgtttagggctgtctgcatattaataytccagtctagaggaaacatgtgagacaatacactctggggtggagtatgtgtcttatcttctttactcttactctagtaatattgcctattcttgtgtcttaattcccactagactcttactagtgttctctttatgtatggacatttcaggagcagtttcagtggctaaagatgcagtttgctgtaaaactattgctggaagcttaagsagctataattttatatgaatagtaccttgaattaaatatttaatagaggaaagagtcctgaagccgttagggttgaagagagtgctcatattttgtttctgtgttgtaatggtaggaatagataccttgttggtataaagtttggttttccattgtatgtgattgtatatctaaaattagacctggttctttataatgtgcctctagggaagccttgcttctgttgactcctggtagtcttctcttttatgtatccagggctgactgggaatgagaagacatgaaattagtttctgacaggatcccttttaggggaatacttactgtgtttgaaatggcaatattgttttcgtatgactggtactgaaaagaagaaataaaagtctttaggaaatttggctgatgtgttaaaagggaaagtataagacgctggaaaaataaatttgcacaagtcaaggataccacagatgtataaatactggaagtccaaggagcagtaatactactttatgaggttgtttacttctgagtcctttttgttaccatgcagatttttattgtttttttcttcttttatattttccttttccctcataccttctctgagctcatacagagttttatttctctttttcttaatttttttttttttgagacaaggtcttgctctgttgcccagactgcagtgcagtggcacaatcacggctcactgcagtctcaacctcccaggctcaagtgattaagcgatcctcccacctcagcctcctgagtagttgggactaccagtgcatgccaccacacctagctaaattttgtatttttcatagagacggagttttgccctgttgcccagcctggtctcaaactcctgggctcaagcagtcctcctgccttggcctcccaaagtactgggattacaggcttgagtcaccacacccagcctgttttctctttttcattgtagacaaagaactcttcttttaaaagtataaaatgtagactgccaggctgggtagattatggatgtgatccacttattgaaaaaatatttataggcgggctgtggtggcttatgcctataatcatagcacttcaggaggctgaggccggcggatcacctgagttcaagagtttgagaccagcctggccaacatggtgaaaccctgtctccagtaaaaatagaaaaattagctggacatggtggcaggcacctataatcccagctactggggaggctgaggtaggagagtcgcttcaaccggggaggtagaggttgcagtgagccgagaccacgccattgcactccaacctgggcaaaagaacgaaactctgtctcaaaaagaaaattttattaaactgtcagcatgtcttaggctttaaatatgattgcttaggctgggtgcggtggctcatgcctgtaatcccagcacttttgggaggccaaggtgggcggatcacgaggtcaggagatcgagaccatcctagctaacacaatgaaaccccgtctctactaaaaatacaaaaaattagccaggcatggtggtgggcgcctgtagtcccagctactcgggaggctgaggcaggagaatggcgtgaactcaggaggcraagcttgcagtgagtcgagatagtgccactgcactccagcctgggtgacagagtgagactccatctcaaaaaaaaaaaaaaaaaaagattgcttctggtgacggaaaaatgaatattgtgtgttttctgctctcaaataaatcatagtattcagactgtcatttgatgtctttatcaatgttatcagaggaaaggggaaactttgaggggaagtgttttggggaaactattggagttacttttcagatgattctggatctttcttaattttatggactattggaattccagaattaaaagctaccttgggatgatccagtataaccttgcacctgatagtagtgttttcttataccatttctgccacgtggttacccagtagctacttgtacatgcttagtaatatgccagccatttccattacaggtttagtaccccttatccgaaatgcttgggaccagaagtattttaaattttggatttgtaaagattctggaatatttgcatagacataatgagatatctcagggatgggacccaggtctaaatataaaatttatttatgttcttccttgttggtatagtggttagttttttttttttaaggtattttatttatgtcccatatacacctatagcctgaaggtaactttataaaatattttaaataattttgtgcatgaaacaaagtttaccttaagtgcttatgtgtggaattttccacttgtgtcataatgtgggctctcaaaaagtttcagattttggagcattttggatttcaaattttcagatcagaaatgctcaacctgtrttagacactggaagccttagaaaattctccttactgtaagccccagtttactacctaataactaccacctagttatatcttctgtgcaacaaatayggtcactgcrcatgggtgcccacctgaggagggcaggggctgaaacccagcttcattctgcatgtcaaaccatgcacctgcaggactgtagaaacggctggtgccgttttctaattggcacagagctgctgtatggactagctggaggtctaacagcaaaggaagtattgatatattcccttccaaatcacaggctttacacaatacaactaggagaagaaagccaaactaaaattcaaatgtactaartttttttcctatctctgggtgactttgggcaaatcattgaatctttcaacctcagatttattataagtaaaataaagtaacacctctcttaacctaccttaatgggtccaaaagctcatgttgacaaaacggttctctgactcactgtagggtcagaattactggctgtgactgcacataggagaatcatttctaatttttataacattttgcttcacagggaggctgagaagacaaaactccttatagctgcacagaaacaaaaggttgtggaaaaagaagctgagacagagaggaaaaaggcagttataggtacttggatttctctgaaatgattgtctctaagtacatttgtttgtcctgttctttgtcagtctcattttgggtatcatgggactcagtaagattgcatcataggtagtggggaattctggaatctccactgtacattcagatgttctaaagcctttaaaagtaggtgagaccagtacttaatgatgtgctgtggctgtccatcatgttgttagatgctactgttgtctctttcaagaacagggagaatggatagggtttataggcagcttgagtctgtggatagcattttcatttgtacagattaagaatagggaagttttttgaccaaagtttcagrttgtagtatgcatccttgttgttgacatgcacttagttttacctggataggtagtgccgtttatgaaagcatggcaggattgtttacagttcatttcagattacagtggcttcccttatactccaggtcactgtgtattagattgccctctttggccctcggttgatgctgaaagtttaatacrtctttaattaaataattcaattatagaggaatgtacagagaacaatataatgaaagcttaagattttgccttattcccttcagatcttttttttttttttttaagaaaaaaattaaatatctgtttgaagcctcctttgtatgttcactggtcctactctttgacttttcttctcagattaacttctattctgaagttgatgtatatcctttctgtccatatttttatacttttactgtaagtgtgtaagagtttataaaattgttttacctgtttgaaactacaaaaatgttaccaaactcttattttacaacttgccttattttcactaacattgagttttattcatattgatacatgtagatctagggattttttctttttttggcattttatccttattctctgtgagatggtagatcgtttatgtttagctgctacatttttcgttctatgagcgggcctagttttattgtaatgaattaccaatgaggagttaggtagtttctagtttttccttattacaaacactgccacaataacattcttatccagtgcctcctggatacagtgtacatgtgcaggtttccatagagtagcattactcagtgtatggtgtgggccagtgccctatcaccagctttttgtttctgagcctcaatgagatgagtatagaaattgagaatgagtgtttagaagtttttatagcattttaatacagcagttttatgtctgttgaatcaaaaataaaaaatcagagcttatatatttatgtttttgttttttaatttcttttttctagtactgtaatttgtttttgttatagtttacaatttattggttcctcataaattgaaatacacacacaaaaaggtaaggtayttttccacaggtrgtttgagaagcactgctctagaatagctatctcaaagtagaattgatgggtcatagggtagcatgtcttcacattcaacatattgacaaattgctctctcaagtacttctttgattttaccatctcttcaacaatatttgatatccagtttctatgctgccatatttgaattcccatttccacacatccttcttggtccttggagttatcagacttaaaactttatgtctgtttaatggaagacatggtatcacataatttcaatttgaatttccctgattgttagtaaagttgaatattgcttattggtcattcaagtttccttttttgttgttgttatatgaattgcctgttaatgtccttagcccattatttgattgcttttttgagttgatttgtaagagtcctttctgtctcctggatactgatcctttttcagatttatgcatttccaacatctttcaatttgtggcttgtctttgaactttacaatgtcttcgatatacatatatgtgtagtttttgtgtagacaaattcattagtcttttcctttatgttttgtgcttttcctatcttaagaattctttccctagtccaaagtaagacttttattctaaaagttttaaagttttgcttttcatatttaagtctttagcccatctagaatttattttggtgttgagtatgacatagggattcagtttaattttttcaagtggcaagccaattgtctcagactgtttattgaatagtttattatttcctctacttatttctaatgccatatccatcatataataagatactatacataatttattctgatgccataatctattattttccaattttttggtctctccttcctcaatattaatttgttttaattattgtagcttttatgttaagtcttgcgatgtggagagtgagttgtgtaactatttctcttacctgttaactattcctaactatatttaaaattatcctggactattctaggccctttattcatccacatgaattttagaaccagctccttaagttttgtgaaatattgtgttgggattttgattggaattgcattgaatgtatgcatcaatttggagaaaattatgatattgagtcttataaatctgtttctccatttaggagagttgtcttttaaaaagtgtcataattttcttctaaagttcttgcacatttattaaagatttgttcttatatacctttatttttttattgacttttttaaaggcacattttctaatgggttttgtataagtatgctgttgatttttttatttagcaatattgctgaagatgctcttatttctaatagtcgcttagatttcccatgaacaatcatatggtcttcagacaataggtccttatcttcacataaggacaattttatttttcttctaagtcacatactttttatttcttcctgtcttactgctttaggctatgacttctaagtacagtgtagaaaagaaagtgacaagtattcttgtccttaactttaaatagtcccagtgacatttgctgtacttaacactggttaataaagtttcaatctgtactttgcttgctgagagctttcattttgaatggctgttaaaactttcagaatttttttgagacagggtctcgctttgccacccaggctggagtacagtggtgtaatcacagttcactgcagcctcagcctcctaggcttaagttattttcccacctcagcctctcgagtagctgagactacaagtgcacgccaccacacccaggtaatttttgtattttctgtagagacagggtttcaccatgttgcccaggctggtcttgaattcctgagttcaagtgatccacctgcctcagtcttccaaagtgctaggattacaggtgtgagccactgtgcccagtctgaaaattttttctacatatattgagatgtttttaaagctgttaatatggtaaattatattaacagatttatctttgtgtttctgggacaaacaatccacttggtcattatataggtcattatatacatttttatatagtttgctgataatttctttagaatttttacctttattttcataaatgagatcagcttataattttcttatacttttagtgttaggtttttttgtatcatggttatactatccccaagatgagttgaagagcatggcttccttttctgtgttctattgtatatcacatcattatgtatcagatctgtataatttcatctttgtaggtctggtggaactcgtaaaagccatcttagtcttgtgaggtttctgctttttttcatttgctttttgtggtaacagttaatctattgatttaattcctgtattgagtataggtatattcagatacatgttttctttttaagccagttttggtaattatattttcatagaaaattgttcatttcatctgatatttcaaattttggggcataaatttgttcgtagaattctctcatgatttttaaaacctctaccaaatctgtgtgccccttttcattgctaatactgttttcttgtgccttttcttttgctgtatcaattttgccagaggtctgttttattttatttatcttttcagagaattggcttttgttttggttttgttgattgttactttgtttaaattatattatttacactttttaaaaaatatttccttccatcttttttttttttttagttcatttgttcttttttaacttcttgagttggatagttaagtttaagtcttttctagtggaaacatggaagattataaattttcttctaaggattgctttagctatgtttcacaggttttgaaatgtactttgtatattggtgttcagttttaattctwaaccttttccttctaatttcttctttggctcatgaattattaaaagtatatgcttcaatttctggtttagtgggttttgaggggctacctttttattgttgatttccagtgttactacattgtagtcagaaaataagacctgttatatggattcttaaatatttattgaaaattgctttgtggcctacctgtacacggtccttttttgtaaatgtctgtgtgcttgaaaagattgaatctgtgttctctggttgttggatgcaggtttctttatatactcatttggtcaggcttatgaattgtgttgttcacatcttctgtattcttctaatttttgccttcttgacctatcaattactgagaaggatgtgttaaaatttcccactatgaccatgggtttgttgacttgtaatttttttctttatatattttgggactatatcattaagaacattcaggttcaggattgttatatctccctggagaattgcttctgttttgtaataatctttatccctagatatgtttttaacttaagagctattttgcctgataatatagctataccagatttttcttggttagttattttcttggtgtaccttttcccattcttttactttcaacttttctatgtcattatgttttaggtgtgtctcttgtaaacagcatatagctggattttgtaatcttatccaatgtgagaatctgtcttttaactggtgagtttagtctttttatatttattgtggttactgctatatttggatgtgtttgtatcatttgattatgtgctatttaccatgcatttttctctgcttctttttcccttttctgattggtattgaattgattgaattttcttttcttttcttccttttacttgattggaagttttacattccattgctggaatgtataactagttgttaatcattctatcctcttcttgaacagtaccttagaatgctttaactcttatcactgtcctccagtcttacattttattattgcgtagtattttagtttcatgttgtctttatcctcccatcaattatgatcattatgattaatccttacagtaaacacttattttgattgacatgtgttgagtaatgttttttcctctccattgtttctggtgattttttttttctagtaatttttttttcagtgaagactaaggagtgaaagttatcttcggtcctccttggtctgaaaatgcttttattttatccttgaatggtaatttagcctacaattctaaaccaagctaatttttccttatcaatatggcagtattatttcaattttgtttggctgcttgcacctatttacaagtatgttgttagtccagttgttccttttgagtaatcagcctttcttctctttttgcttttaacatgtttctgtctgtatttgggtgttcttcagtttcactgtgatgtggctaggtagagaagaggttacttcttaactgggctggttggtagagtgttttagttcccctttcattagagttgcagccctctagaggtctcagttttatgcaagggtcttagtcctaatatcacaaggcctcatctcctggtcttgcatgggtaaaaacccaggtcccactcccttcttgtctaataaccaccccagggacaccaccatacaggctctcggctcccccttggcttaagttacttgaggatctctcattctttcttacaactcagccatgcattaaaaaacaaatttgctatatttcatctagcattttaagaggttgttagctaaagggttttctctctggccttttggccttttgcaccatttttctagaagtctggtcgtgctttttattgatttattcccacatgacagagctttgttgaatgagattaccacaacagtccccctatgttgaggtaacatcctttgggttctagctgcaggcttcagatccctcaccttttattcatgttttatcttgagtttctgcttacagttcaatttctagccccattgaacatagtagtttagtttttggatggtgtaatatagattgattttacattggtggagaaagagggaattatctcctggagyagttcgtaaagcatactgttttatggaaagaaaaaaatcacttggaagttttctttccattatgtactttttctaggggtcagagataagatgtcctaaaatacccatcttctttgactgaaaaggagaattgagaatgttctttaagaatagcagtgattgaatgtaaagtgtaattcaagtctttcttccttgtcctgggtcatttgggtaggccagaggtttattaagggtgttgagtttcctctgcatgtacttgcttgccacaccaacatgttcactcccaatgcttgttttcaccttctcaaatgaatcaccctgctttctgctttatttccctacagcagttggaatactcctcttctgataccattttcatcctgtcatttccctaatggtaacttaacagtagatcctgagtatagtaaaactaagctccttagcctgtcactcaagacagaggtctcctagccctctttctcttcttattttwtgttgtcttcgcttgttggctggttccatatcacctctccattgtgacttgttcatttgtgccttcttgtctttcttttttttgtttttgtttttgtttttgaggcagggcctcactctgtcacgctggctggagtgcagtggcatgatcatggctcactgtagccttgacctcccaggctcaagagatcctcttgcctcagcctcctgtgtagctgggactataggcacgcaccatcatgcttggctaattttataaattttttctagagatggaggtctcactgtgttgcttaagctggtcttgaactcttgggcttaagagatcctcctgcctcagcctcccaaagtgctggggttacaggcgtgaatcaccatgactggcccttcttgtctttctctgtgcttcctggcatgtcttcttaggtcatatccattatttcctttaagattacttccagaaggtcttccttggtttaacttatgtcactcattctttctttctcctgccacattaattgtcctgtgttgccatgcatttatgttgctctgtttttgttctgtggtactttcataaagtatctttttttcccattagcttgtggaccgttgctacagagttgcatgaaggactggcactttaacctttttttactccttcttcccacaaaactagcactgtcaaaatagaacagtaaattaggaaataaattcccttttttcctttgagtagtttacagtctgactagataaaacttagtgaaacaattagcacataaaactttctgtaattaaatgttagactgtgtgctgctggttcgaagtgcctcaggtactgtagaaatggttttgaatgtgtcttcttatgttgtatgattatagaagcagagaagattgcacaagtggcaaaaattcggtttcagcagaaagtgatggaaaaagaaactgaaaagcgcatttctgaaatcgaaggtacattgtggggagaggatgaagctctgcctgtcccgaactgcctcctctctgctccagggttcaggcctttgattgtggtgggtgagaaggccatagacagaataatctggtctggaggaaatagctggcctgatagtctaaataaatttttttaaattgctatcacatttccagcttttgggtttgtttgtgactgtgggtagctcagctttccttttcttccttaaattggggcttattagctaccactttattttcaggcagacaagrtatgaaaattacccataatcaatagtaaagaatatacaagataataaaccccatctctggccgggcgccgtggctcacgcctgtaatcccagcactttgggaggccgaggcgggcggatcacaaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaaccygggaggcggagcttgcagtgagccgagatcccgccactgcactccagcctgggcgacagagcgagactccgtctcaaaaaataaaaaaaaaattaaaaawaaataaaccccatcacgaccagtttcttttccacctgtccaaaaaaaaaacaaaattaattggggggaaaaacagttttcatggagggcctcacactacttgatttcacatagtgagatgttgatgttcttagctcggtcttgaagtcacttgttatatattgctgcttcctgtctgtctctgttgactgattctggatgaaatttgkgggggggctggagacaatgcagtaaatagagcttttatgtctggacttattttacttgaagcttagtacctgggtggaatgtaaggctctgggtgataggaggtgggagagtgggtggaggagagaaggaacaacttagagtagaaaacaagtaggctcagatgagctgagagttatttgrcagtgaaaagagtattcctcgtagagaagttgctstttggggactgggacttgaaaactgctaataggtttttaaaactttcaatgtgaaataagcagtcacaatattaagcagtggggaaagggactcttaactagctgagggaatggattgacacctttcctttgtttatttgctagatgctgcattcctggcccgagagaaagcgaaagcagatgctgaatattatgctgcacacaaatatgccacctcaaacaaggtgactggctccctggccactttcctaatgatgcatttcggggttttgctttctcttttcaggagctctgatatgatagaagtgattttatccattgtcaagaaagtgtagtgaccaagacatcctccagaattagtcagttagcaagaaatatttcacattgattgggtagggacacaggccaaatgccgtaattccattcatttgtactgctatataaggctgaataattaattaagttgaaggtcttctgaaataagagtgacagaagagtaaagtctatttagaattgctttccaaataaggtagtttttttggtagatacttagcttgattagagcagtatttctcatcaaaggcattcctggcatttggggttgagatactttttcattgttgaagaccatctcatgcattgtaggatattttgtatccctggcccttgtctactgaatgtcagtagtggtcaccagttgttttaactgccacacacacatgcatgtatttccatatgccccttgttgagtactccttgtttattggatttaaaaaactattccagtcatgaggaatttcatgtgggataacttgagaaggcaggttgggtgatatataggtgataatttggtgtaaggactggggtaagctggctagacggtacagggctagtgagcaggggctatttaagaggcagctagaactccgatagtattctgagaagggaagggtatgtccaagatttataaggttatcgtggagcagattggaacagataaagggttgagaaagagattactaaagtggatgatgcagtttgaaggattagagtcaagttttaagatatagacagggcttttaatttagaaaggaacaacataatccgtatttagaagaaatgataagatgatagaatgagagttgtcagtactttgaaaaccaatataaattttaaaatgaacataacattgaaagacacagttctatagacacagaatggaatttggccaaaagaaaggcatgacaggaaactccagttgaggaaactaggagtccaaatctaatgggagaagctcgtcaggcacaagtttcaagaccttgccattgaggtctaccttattcagaaaggggcagtagttttatgccattttgaaaaatgtgactcagatactaacctatattaaaaaggcttgaggaagaaatgtggttgtgcactatgaccagatttgattggagtgtttcgacagaggatatgaatcacctggagaagatagagatccaaagagtgaaagatgtcaaagtgtagaaaataaatgctgtaggactgtgaaggacaagatggacttttgcctgggggacaggccaggactcaagataaggagaggatcacagagcagggtctgaggggctttgaaaggcatatgttacagggaacagtggaaatgggttttaatcaaatccagatagattctggttagatacatcttggcatcctgatttagacaaaacaaaacagtgtgacagagggagatctggtggtcgacgagttttaatcaaacccagataggttctggttagatacatcttggcatcctgatttaaacaaaacactgtcacatagatctggtggtcgacaaacatctgtctgtcacaagcagcttaaacatccagcttctggggaaaggcagaaggccagatcaggtgacaacttgagattttattctagttctagaatttgttcaagaaaagcagaatcacagctaatgataagataatgagcaccagcccttcctttgaagttctgctctcatccactgacctgtgtatctctctcaagagaatcaacagagaaccaggcatgatggctcattcctgtagcctccctggaggctaagatgagagtatctcttgagcccagaagtttgaggctgcagcagcgagctataattgaaccactgtattccagcctgggcaacagagtgagatctcatctccagaaaaaaaaaaggctgggtgcagtggctcacatctttgattccgacactttgggaggccaaggtaggaggattgcttgaggccaggagtttgagaccagcctggcaacatagaccccatctctacaaaaataaaaataatttttttagaaaagagaatcaacagaaactccagaccaattccaggttgaattcaactagatgaaatgaaagtcactttagaaatattagttattatcattagttatcacaaattgttttccaactcccccatccttttattaaaaagtgaacagcttctcttgcattaagtcaggagcttaatgaaggaattttaagtcaggaacgcagctgttaatgtgatagccactctccaaagtgagagagggtcattggcagttattcagacttgactcatgatactcaggagarcaataggtgaaatgtatatagggagagagaagactgttgcaccagagtattctgatgcctttgctcttgtttgctcccacacagcacaagttgaccccggaatatctggagctcaaaaagtaccaggccrttgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctrtatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtmtgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccytgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacrctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtgatttgtgtttttttttcccacgtcttcatttttctgtcatcttaacatgctcctaaggctgtcttgcacatttcaactagggagccagtttatttgcgggtttaacttaactgtagaggcttttgttatactcttgccagaatactgcctacctggtataagaatgtttaaaacaaggtgtccactctttgctgactcctggaatttaacaaggggtgttcttctaatcctttgtgggacagggcctgtggcagaggggcaaggagggaggatggagcatcaggccactgggatccgtccctgagagcaaaagtacttctgcactgaggaggggaggagacagaccaagccagagaaggacaatttgtgtaaattataactggtaatgtaatggcacaatataaccaacttgactattaagatgttagcggcccaagagccagagttggacctgctcttcccaaacgttctgtatttcctcctgggatcaatttcctggtgatcttgggccagcagggagtggtaatgggagttgtggggaaagcagctctttcctcctgttcttatgggatcaaccccatagtatcctaggtcagttgctgtggacctgagaataatttgaactgaccatcctataggttattggtaggtattaaaatgaagtgatttctgcctcttctgtggcaaaagaatttgtgaattagaagccgtggcttctaatcgctttaggattaagtctcaaatgtgtacacacgaagttcgtgatctggcccctgctgtcctctccagccacccttctctaaggtccctgaatgcaccttctgtctgtcccttctcatacgttgttccatctgcctggttcactttccttccctcgtagtgctgactttcctcagccaactcctgagtcttcatcacttcttcagatgtaaaagcttcagttcactttgaactgcttggcctgggttagcatcctgtatttcccccccgtcacacatcatgcacacttcatgtctcattatgtgctcaatgtctgttttcacaaatgctaatctctctgagggcgggggcgggggctgtggctgtgctgttccctggggattgtttctgttgctaatgcctaagatggcatctggcccatatgagatggctttgttgcatgaaagaacaaaaagttgaatatgacatgcaggtaaatcaggcaagtgagtcatggaaaaaacttagaagtgagcctacagtgtccatgtcaggactttatgtgtaaccatgggaagttacctaacatctctgaacctgattactcatccttgcagggtgactcttcagtggattcaggaggatatgttgttgcatctagtgtagagattcgcacgtggtaattgctgggatgcattagttcaccttgtctacaggagtcagttgtctacaggagtcaatatatgtgtctgtctctgagtagctataagttcccatagtggagagagtgagcacagtgcctgctacctgcaattgcataatagaacacgtagattaatgtcttcaccagctatgagctaagctagctggatgttaaaccccaaccacagccctccaggagcatcccaacaagctgggccagcttctcatctttctcctggtctctgccctggtatgagcacttaaaatgaatttactgggccgggtgcagtggttcatgcctgtaatcccagcactttgggaggctgaggcggtcagatcatgaggtcaggagctcaagaccagcctgatcaacatggtgaaacctcatctctactaaaaatacaaaaattagctgggtgtggtggcacgtgcctataatccccagctactcaggaggctgaggcaggagaatcacttgaacctgggaggtggaggttgtagtgagctgagatcgagccactgcactccaggctgggcgacagagcaagactctgtctcaaaacaaacaaacaaaaaaaaacaaaaaatttactgttaattcattgctcactcctagtgtctattttgacatagactgtaatgcagaatgacgttttacttgtttcccttaccatatttcttctgaattagtacctgtctttccaatttttcttatttctttcaatcaatttttctactttttttttttttaattttaaaaaatgtcttcttccagtggggctcggtggctcacacctgtaatcccagcattttggaaggctaaggcgggcagatcaactgaggtcaggagtttgagaccagcctggctaacatggtgaaactctgtttctactaaaaatacacacaaaaaatagtctcctttctttcttcctataaatatttattgagtatctactgtaggctagttgctgaggcaacaaaaagccatatagccttgtgtgtgtgtgtaggatggggcaatacagcaagtaagtaggcaagtgtgatagtgtggtaagtaagcagggtgttcactgggtgctgtggggcaccagtaaagatcagcccagccttttggtttctaggaagcaatgtctgatctgagccaaatttttaaggatggacaggaggcagacagccagctgaagagagcagtggtgatggtggagtgtgttccaggcagtgggagaagcacttgctattgcatttcaaaatgcagtgccaggaggcatgagaggctgtccactgcaaaccttatgaggctctactattacttcatttcatagctgagatctagagagattacattactcaagatcccatgaatatgagtggcaaagtaaggatttgaacctgtcatattccagatccaagtttaccacagccctttatatttgcctttgaagccattaggtttagggtgatgaaagctctaaattgaggggagattttagaggatgtttatagagatttgtaagccctgcagtcgaggtcaggaaaagggataatgagatggttcatgtgtgaagtggtgacttatgggtgacttctctgccctctgcaggacttggcagaggtgctcttagtaagctgagcggtatgacagctgattccagaaagatcagccctttggagcctgggggagcagctccccttatttgggttacaaagcaagtggaggtgaacagtgcagggctgatggcacaacacccagatcctgtttgcagatgttaatcactcattctcctggttgctgggagtgttcatggtgacagcttttagcagagtcgctctgcagaaattttcctcggctaaagacccctgccccgggccaagatcacatccccttcctggggacagcacattccataagtggttgatgcaggggtagaaaggcaatttgttcaaaacaaaattgcattggttttctccatatgcaagtctgtcagggtgtgcatcctaataggcacaataactgtaactggatttcagacacctaaggcaggttctgacaaactgggtgtgtctgatgcctctggcgccctatcgcaattccactccaccccacctctaactccagctgtggccatggtagacagttccatgaggcatcaattcactttcctctgactgcatctcacctcacacatgagctgcacttactgcttttcaccctagggatcctccaacgctatggaggctgcagtcagtccaaacatatgctcaactcgagcacaagaattaatagcctctgggacaacccccaactggtaggagacaggaccacaaatggttagagaggaggtgacccaaaaaaaccttttcaatggagacagcaaccctcctgacacaagagaaactgtgaaaatcacattaaatacaattcgacagatgtttgttgagtacctgatatgtgccaggaaacctaaaatgtataaagtaatgggccagtaatgaacaacagtgagtcagacagacatagtctctgctctcttagaatcaacagtcttgggctgggcgtggtggctcacgcctgtaatcccagcactttcggaggcagaggcaggcggatcacaaggtcaggagttcgagaccagcctggccaatatggtgaaaccccatctctactaaaaatacaaaaattagccgggtgtggtggcatgtgcctgtagtcccagctacttggtaggctgaggcaggagaatcacttgaagccaggaggcagaggttgcagtgagctgagatcacgccactgcactccagcctgggggacagagtgagactccgtctcaaaaaaaaaaagaacagtctggtgggaaagtagaccgtaaccaaagcacttgagagacttatcaaagtgggaggaatgcagtgctaggagggtctcaaaaaagagggagaagataaagaatgaaaaagagcatccgccagttaaagatcggggaataacaactcaataaaaagacaacccaattttaaaatgggcaaaggatctcaacagacatttcttcagacaaggtatacaaatggccaataaaaacatgaaaaagggccgggcgcagtggctcaagcctgtaatcccagcactttgggaggccgaggctggcggatcacgaggtcagaagatcgaggccatcctggctaacacggtgaaaccccgtctctactaaaaatacaaaaaattagcccggcgtggtggcgggcacctgtagtcccagctacttgggaggctgaggcaggagaatggcgtgaacccaggaggcggagcttgcagtgagccgagatcgcgccaccgcactccagcctgggcgacagagcaagactccgtctcaaaaaaaaaaaaaaaaatgagaaagatggtcgacatctttagtcattagaggaatgcaacaagatagccacttcacacccactaggatggctataataagaaaggcagtaactagtgtgggcaaggaagtgaagcaattggaatctgcataatttgctggtaggaatgtaaaatgagggcactgccttagaaaacattttacagtttctcaaaatgttaaacagagttaacatacgatccagcaatctcacttctgggtatctacccaaaagaatgggaacatgtccacacgaagacttgcgctctatagcagcattatgcatagtagccagaaggtggacacaaccccagagtgtccatcacctgatgaatggataaatcagatgtggtctatccatgcaatggaatattctataaaaaaggaatgaagtactgatgcatgctacaacacgaataagccttgaaaacattaggctaagaggaagaagccaggttctagttacattaaatgttcatcatagacacatccctatggacgaaaagactggtggttgcctgaggctgggaggagagggaattgagtagctgctaatgggcacggcgtttcttcttggggtaatgaagagattttaaaatttgattttggtggtagttgcataattctgcatatactaaaaactattgaggctgggcacggtggctcacgcctgttatcccagcactttgggaggccgaggtgggcagatcatttgaggtcaggagtttgagactagcccagccaacatggtgaaatcctgtctctactaaaaatacaaaaaaaagtagctgggcctggtggcctccgcctgtaatcccagctactggaggaggctgaggcaggagaatcacttgaacccaggagacggaggttgcagtgagccaagatcgcacgtgccactgcactccagcctgggtgagagagcaagactccatctcaaaaaataaaaatttaaaaaataaaaaataaaaactactgaactgtatactttaaattataaattacatggcatatgaattatatctcaagctgtttttttttaaaggattgagtaatagtgtgaagacctcagttcaagaaccttccagaaatggtaaaaaaatattcaatataggtgcaacattattagtgagaatgagagcaccaaaacaggaggctgaagaggtgggtgtgagaagaggggaagggc

SEQ ID NO: 12488 - DNA, 47622 bp, Homo sapiens
aatcagtcttaccccttcttccaacccttttccttttccgtgcatgtattgatctattttttttttttttttgagatgaagtcttgctctgtcgcctgggctggagtgcagtggtgcgatcttagctcactgcaacctctgtttcctgggttcaagcgattctcctgcctcagcctcccgagtagttgagatttacaggtgcccaccaccatgccaggctaatttttgtatttttagtagagacggggtttcaccatgttggccaggctggtctcgaactcctgaccccaaatgatccacccacctcggcctcccaaagtgctgggattacaggtgtgagccaccgcacccagccatgttgatctatttttaaaaagtttttatttcctgttacactgtgttcagctatcttcagccaccttaaattcccatggatgagttttcataaactttttgaaaatagatttagatttacgggaaagttgcaaagataatacagaatttaatggatgagtttttttattgatgtgtaatagatgtatgtattttcagagtacaagtgataatttaatacatgtatataatgtgtaaatattaaatcaagagttattgggatgtccttcaccttaatatttatcttgtctttatgctaggaacattatttgaattattctcttttacctattttgaaatgtacaatagattaacattagctatagttactctactgatctatcataggtcttatttcttctgtatttgtgtccactaatcaaactcttcatcctcacgtccccaccacctttcctggcctctggtaaccaccaatctacctccatctccatgagatccacttttttagctcccacatgtgagtgagaacatgtaatatttgtcttttctgtgcttggcttagttcagttaacacaatcacctccagtttcatccatgttgctgagaatgacagaatttcattccttttatggctgaacaatattccattgtgtatatataccacattttctttacccattcatccattgatggacacttaggttgattccatattttagctattgtgaatagtgctgcaataaacatgagagtgcatatatctctttgatatattgatttcctttcttttggatacatacccagtagtggaatttgctggatcatattgtagttctatttttagtttttggaggaaactatacaattttccatagtggctgtactaatttacattcccaccaactgtgtacaagagttcctctttctctgcatccttgccagcatctgttaattcctgtcgtcttgataggaaattttaagtgggatgaggtgatatcttgttgtggctttgatttgcatttctctgatgattggtgatgttgagcattttttcttatagctgttggccatttgtatgtcttgagaaatgtctattttgatcttttgctccccccgctttgtttttttaagagatgagttctcattatgttgcccatgctggaatcaaactgggctcaaacagtcctcctgggactgggcatagtggctgaggcctgtaatcccagcactttgggaggctgagtaggtggaccatctgaggtcaggagttcaaggccagcctggccaacatagtgaaaccctatctctactaaaactacaaaaaattagccaggcatggtggtgagcacctgtaatcccagctacttgggaggctgaggcaggagaatcacctggaccccagaggtggaagttgcagtgagctgagactgtgccactgcactccaacctgggtgacagagtgagactccatctccccaccccctccccctcccccaaaaaaaccctcctgcttcagcctcctgagtagctgggactacaggcaagcaccaccacatatggctttgcccatttttagacaggattttttgtgggtttttttcgctattgagttgtttgagctccttgttatatttattctggttattaatctcttgtcagatggatagtttgcaaatattttcttccattctgtgggttgcctcttcactttgttgattgtttcctttgctgtgcagagctttttagtttgatataatcctattagtctatttttgcttttgttgcctgtgcttttgaagtcttatacaaaaaatttttgcccagatcaatatcttggaacatttctccagtattttcttctggtagcttcatagtttcatgtgttaggtttaagtctttatccattttgatgcgatttttgtatatggtgagagatagagttgagtttcattcttcagtatagggctatccagttctccaagaatcatttattgaagagactgtcctttcctcattgaatgttcttggcacctttgtacttttggtattgacataaaatgagttggctgtaaatgcatggatttatatatgttccattggtctatgtgtctatttttatgtcagtaccatactgattgggttaccatagctttgtagtagattttgaggttgggcagtatgatgccttcagctttgtgctttttgctcaggattgctttggctctttggggtcttttgtggttccatatagattttaggattgttttttctatttctatttctgtagagcagcagtccctaatctttttggcaccagggaccgcttttatggaagacaatttttccgtggacgcggggggatttttttttttaatggtatgaaccatatttattgaaaacattatttctggcctttctcaaattgaagactgcaaaaaataaaagcagtgctttattgagttgtcattaaccttgagagcagtggcgctgcctctccacgctctggggacggtggaaaccgtggctggtgcgtgccacatctatcacacctcggtctacaaaacagtcctgacgtcaaataaaactattgtggccgggcgcggtggctcacgtctgtaatcccagcactttgggatgccgaggcgggcggatcacgaggtcaaggaaatcgagaccatcctggctaacacggtgaaaactcgtctctactaaaaatacaaaaacaaaattagccaggcatggtggcgggtgcctgtagtcccagctactctggaggctgaggcaggagaatggcgtgaacccgggaggcggagcttgcagtgagcgtagatcgcgccactgcactgcagcctgggcgacagagcgagactcagtctcaaacaaaaacaaaaacaaaacaaaacaaaacaaaaaaaacaaacgctcgtacatgacatttacattagaaaaagagagctgaaagtagggatggggggatggtttggggatgaaactgttccacctcagatcatcaggcatcagattcttgtaaggtacgcagcgccgtagaaccctcgcatgtgcagttcacaatagggttccagcctctgtaagaatctgatgccaccactaatctgataggaagtgagctcaggcggttattctcacttgcccaccgctcgcctcctgctgtgcgtcctggtttctgatgggtactggtccatagcccgggggttggggatccttgctctatctagagaatgccatttgtattttgatggggattggactgaatctgtaaattgctttaggtagtgttgtcttttttctttctttcttttttttttttttgagacggagtctcgctctgttgcccaggctagaggctggagtgcagtggctggatctccgctcactgcaagctctgcctcgcgggttcatgccattctgctgcctcagccttccgagtacctgggactacaggcgcccgctaccacgcctggctaatttttttgtatttttaggagagacggggtttcaccgtgttagccaggaaggtctcgatctcctgacctcgtgatctgcccgcctaattcttctaatccataagcgtggaatatctttcctttttgtgtgtgtgtcctctttcatcagtattgtatagttttccttgtatagatctttcatttctttagttaaattgattcctacgtagtttatattctttgtagctgttgtaaatgagattgcttttttgatttctttttcagattgtttactgttggtgcatataaatgctactgatttttgtatgttgatttggtatcctgaaacttttactgaattcgtttattatttctaacagtctttttcgtggagtcttttgatttttcaatacgatgagtttttatgtcttacttttgtatcctcttctgggaattattacctgctcatgtttggcaaacttctactcttcttcaagattcagtcttgagtgctactcctgggcagtgctgtattatccaaagagtaggaaaaaatgcatgcttatgtgccagcaaagcagagccaccagttatgaggcaagaaacaaacaaaaaagaaggcttgtaggctgtgggaaaagccagaactttgtagttttgtttggttattgagacagggcttgctgtgtcacccaggctggagtgcagtggcaaggtaatagctcgctgaagcctccatctcctgggctcaagtgatctccccacctcagcctctggagtacctgggagtacaggcatacggccaccatgcccagctaacttttttttttttctttttaaatttgtagtagagacgaggtctggctatgttgcccaggttggccttgaactcctgttctcaagtgaacctcccgcctcagcctcccaaagtgctgggattacaggcatgagccactgtgcctggcctgtagttcttctttaatcttatgttttattaattttgaattatttagatgcccttgatgagtcttcctttccccgcagtcgtcaggaactctctcttgtttccatttccttacacacttgtttcctaccacttggcctgaacccttcaaaaaagtcaatattacaaaaactaaaaccaaataggtaggagggcttttgtagattaaaatagagacagaaccaaatgcaagtgtgaaacttgattgcatctgaatcaaaacaagccccaaatataaaatcagtttgtagggaaatatggagaactttaaatatggatgtatattaggtaatattattgaataattaatgttaattttcttagctgtgttaatagtattacggttatgtaggaggatatcctaatcttaggagataaatggagatgtattcctgttgtccgcactttattttattttattttttgacacggagtctcgctctgtcgcccaggctggagtgaagtggcgcgatctcggctcactgcaacttcctcctcctgggttcaagcgattcccctgcctcagcctcccgagtaactgggactgcaggtgcgtgccaccacgcccggctaattttttgtatttttagtagagagggggtttcaccgtgttagccaggatggtctggatctcccaaagtgctgggattacaggcgtgagccactgcgcccggcctgtactttactttcaaatgattgagtgagaatggaagggcttgggcactttgagagaaagagaacacaagcaaatttgccaacatgctgagacttactgaatcaaggtaatagccattattcttttaacttttttttttttaatttgagacggagtttcgctcttgttgtccaggctggagtgcaatggcgcgatcttgactcactgcaacccccgcctccctggttgaagcaattctccaccatgcccggctaatttttgtatttttagaagagacggggtttcaccatgttgcccaggctggtcttgaacgcccgacctcaagtgatccgcccgcctcagccttccaaagtgctgggattataggcgtgagcgtccacgcccggcctcttaactttttgataggttaaaaacttacaaaaaacgtggatagagggggtctgtcttgcccactagaccgatatggtgttggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcrctgacgtctgattgttgcgcggtcgcatttttccggggaacgcggattcgcattcccaattttaggtggcagtcgcaacccrtactattcggacagatggcacagaaaccgctgcgcctgtgagtgaccgtgaatggaagcctctctccctgtgtctctttcgtgtgtgtaggtgacgacacgggcgggagtctttcccatgacgggaagggagaaggaaaaggcggagagacacggggctgctggggagcttaggtgatgtctttgcctggccggggctgacctcttttcctggcccttttcgcttctgagggggtttctcttggcgacgctcgttcggagaggcggaagctcccagagttaggcctcctccatcttagggggcagtcctggcctctgacacatcctttccccttcgtttctcctgaccccatttatttactcgccaaatagccattgggcccactgatgggccctgggcagtggtggacagagtagatagggacccttccctggggcattttttttttttttttttttttgcgaggaggaggggtgggggtggtggtgaagagagggcttcatgcagcaagtatttattgaagaactgcagtgtgccggacgctgtgctaggtgttgcaacagatggagttcctgctttaatggagcgtagagtctagaggaacaggtactaaagaatccagataatgggccgggcgcggtggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctsacgcctgtaatcctagcactttgggaggctgaggcgggcggatcacttgcggtcaggagttcgagaccagcctggccaacgtggtgacaccccgtctctactaatacaaaaaaaaaaaattagccaggcgtggtggcgcgtgcctgtaatcccagctacttgggaggctgaggcaggagaatcgcttgaacccggaggcggaggttgcacagtgagccgacactgcacctctgcactccagcctaggtaacagagtgagactccgtctaaaaaaaaaggaattcagataaatgtaaagttaccatagtgatagggccaggcgcagtggctcacgcctataatcccagcgactccggaggccaaggcaagagaatcacttgagtccaggaattcaagaccagcctgggcaatatagcaaggccccgtttctacaaaaaatacagaaaaaaaaaaaaattagccgggcgtggtggtcccagctaattgggaggctgaagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgataggagtcaagaaggcttcccgagaatgttaggattgagccttgggaaataagagtaatccattgcttaacagcagggttatgttctgagaaatgagttggtaggcgatttcgtcattgtgcgaacatctttgagtgtacttccagagacctagatggtatggcttcctgtacacytaggctaaatggtatagctgtacgtcaagttactgtactgaatactgtaggcaattgtaacacaatggtaagcatttttgtatttaaatatagaaagggtacagtgaaaacacctggcygggtgtggtggcttatgcctgtaatcccaacactttgggaggccgaggtgggtggatcacctgaggtcagaagttcaagaccagcctggccaacatggtgaaaccctgtgtctactaaacatacaaaaattagccgggtgtggtagcgggcgcctgtaatcccagctactcaagaggttgaggcaggagaatggcttgagcctgggaggcagaggttgcagtgagccgagatcgcaccactgcactccagcctgggcgacagagcgagactgtctcaaaaaaaaaaaaaaagaaaaagaaaaaaagaaaatactgtatacaggaaaaaaaaaaagggcacaacctgtgtaggacacttatcatgaatggagtttgcagaactgaaagtttctctgagtgagttagtaagaggtgagtgaatgtattactttacagtattgtagactttatgaatactgtacacttcacctatattaaatttattaaaatattattttcaacagtaaaccttagtttactgtaacttttactttataaactttaagtttttttacactttttgactcttgttataacacagctaagacataaaacacattgtacagctgtacaaaaatattttctttatatccttattctacaagcttttttctattactttttttttctttttaccttttaaactttttttttttttggagacagggtctcactgtcgcccaggctggagtgcaattgtgcaatcacggctcactgcaacctcaacctcctgggctcaagtgattctcccacttcagcctcctgagtagctgggactacaggcggaagctaccacacctggctaatttctgtattttttgtagagagggggttttgctatgttacccaggctggtcttgaactcctgggctcaagttaccctcctgcctcagcctcccaaagtgctgggattacagacgtgagccactgtgcctggctttaaacttgttttgttgcaaactaagacacacacacgagtctaggcctacacagggtcaggatcatcagtatcactgctgttcacctccatatcttgtcccactggaagggcttcagtagtaataacatgcatgaagctgtcatctcctatgataacagtgccctctggaatacttcctgaaggacctgcctgaggcttttttacagtcaactttttttttttttttttgaatacgtaggagtrtactctaaacagtaaagagcataccatactgaatatatttttttttttttgagatggagtcttgctctgttgcccaggctggagtgcagtgccrcgatctcagctcactgcaagctctgcctcgtgggttcatgctattctcccgcctcagcctcctgagtagctgggactacaggcgcccgccaccacgcccggctaattttttgtatttttagtagagatgaggtttcactgtgttaaccaggatggtctcgagctcctgaccttgtgatccgctcgccttggcctcccaaagtgctgggattacaggygtaagccaccgcacctggccatagcatgctaaatattatacataaaccagtaacatagttgtttattatcattatcaaatattgtatactgtacataactgtatgtgctacactttttataaccaccagcccagtaggtttataccagcattaccacaaacaaatgagtaatatattgcactatgatgttacaaatggctagacatcactaggcgataggaattttttagttccattataatcttatgggaccaccattacatatgtggtcccttgttgaccgaaacattgttatgtggcacrtaactgtattcttgtctttaacctaaaaaggttattgaaatgcttaagaacgctttggcatgatcaaattttcattttggaaagcagttctgtctgcaatgtggagaacaaatcagagccaaagtagagaacagctgggattaggtagagtgatgacagaggaatagtttagggattcagggtttattaaggaagtaaaatcaacaaggcttgtgatggtttaattgtgagtgaaaaggagctggccttgttgggtcatagatttctatctttattcagtgggatagagaacagtggaaaagggcccagatgaggagatgaggcacctggtgatgtataaactggacagtggatctcccagagacaatggtaattccgtgtgacaactgctgtgatggaagaaatgcaggctcctatgggaacactagaaattggtaactgataggtactagaaggcttcctagaggaggtggtgctcaaaatataaataaaagtcatattagtttatgacaaagctttctctgaaatgctgtaatgtggttttctgagtttttgagaaggtaatgacttctgagccagccaggaaggcttcagaaatgtgctaaaccttgaaggatgggaaaaacttggatttaggatgggtagggtggaactaccctagggaatgacagaggcagagagtaatcaaattgccagttcagttaagaaaacttggagaaagtactagaaagrtgacaggtcagggcctgtggaaagctgtggttctataggcagtggggaacctcttaatgttttgaggaaagaacattaaactgactactttctgtaggatggacaggaggaagagaaggcattagaggaaacataaatgtattctctactttgaatctaacactagatgcattgtatttttgtctgattcttcctctgccataggaagggggtgaggtggggtggagtggagtggaggttgcagtgagccaaggtcgtgccactgcactttagcctgggtgacagagtgagaccctgtctcagaaaaagaaaaaaaaaaagtttggcgaggtgtacaataaaagcacgccagaaagagacactcacaaaacaataaaattttaatatttcaagatgagttaaaagacattaaggaaatgatataagccgtggaaaaaccacataaatcagaattagaaaatctcagaaatgagatgatagtaaaagtcacttcacaacgtagggccagtttaccttaccaatgtcagctcttgccattttctacttcctgccccataacacttcacacatacctctgttgtagcccttttcttataaatttataatgattagagtgtcttcctttccctgattataaactctttgaggcttaaactgagtcttcctccaccttgtactgctaacatgtttttagcatagtatacttggcatattgtacttagcgtatggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtccacaaaacttaggaatgaggagaagaagctggctcaattgtggagtaaatgataagctaaattttagatacggcgagtgggaggtgttggtgagaccctcagtggatctgcccagtggtttacgtgcactgaaccttgcaaggtaactgcagagagactagatcatgtatctatctaatccaaaagaccartatataccaaacccggcaggcccatttgtttcctgaattgctataatgtttatctctttgtttgcagcttggcttgtggagatgttgaaggaaagtttgatattttattcaatagagttcaagcaattcagaagaaaagtggaaactttgatgtaagatgtttgtttttactgaatttaattttacctttgtagtcayacataaaaataaagtttgcactcctttaagtcttgattgaacacataccatttttgttaaattgarttcccttcatgagcataggaacttagtagctgctgagtggctgggggagggagacctatttactgtttactattgatctttatattttttgaatttgaatattgttactttatcactgtacaaaaaactgaaaacagactagcaacacttccctaagtgattctgacctctgggtttgggaagcacagatctatttcatgaatgtgatgaggattaagtcaggtaacatacataccaacccatcacaagcttaaaagctctatatgaatgttgtgtatggttgccaactagactgtaaactcctaagagtacagaagagagtattccaggtatgaggataatttgttcattgggttaaaggttgggtaaagacaacaggcaggaaatgtgttttttataccttgtatttctcagattctaatattttaagtttttttgtttcacacggggattctttaaagatctatttctatgtgactgtatattccagggaaggatatgtggagagagccatgaatggcagagtgggactgggaatttgaggagcacttgaattctaacttactttaaaagtttagttccttgactctctcttacccatctctaacttgaatttgacagccaaagagccaaaacttaataattcatagaatcagtaactgttaacagttgctgctaaagaattgtatattgaaatctgcaaattgattaagaattaaaaactgatttgaaactattaaataactagttgaatattactatcaattatgtactgtwtgatattttaaaatctcatatatctgtttaaaaaactcattttagctgctgttgtgtgtaggaaatttctttggctccacccaagatgctgaatgggaggagtataagactggcatcaagaaaggtatagaaattatttttatttaacatatgatttctaataaaatttcaagggccagagttcttgcagagttgtttttcattatttaagaatttaagagttattttcagtatttaagaatttaagttgcttttcattattaagactatccggcgcagtggctcacacctgtaatccccgcactttgggaggccgaggcatgtggatcacctgaggtcaggggttcaagaccagcctggccaacatggtgaaaccgtgtgtctactaaaaatataaaaattagcagggcatggtggygcatgcctgtaatcccagctcctcgggagactgaggcaggagaattgcttgaacctgggaggcggagattgcagtgagccgagatygcaccactgcacttcaccctgggcgacagagcaaggctctgtctcaaaaaaaaaaaaataaaataaataaaatagccaagctacaaggttgggtgtagtatatccttagtggatagctgttccacatttaggattgctaaatatggggaatgtgaatgcatggactatttacttttaatataagtattttttctatagagaggcatatcttaagttctaaagcagatctggtaactatatggtgtcatgtctgtttccctcactagctcctattcagacatatgtgcttggtgctaataaccaggaaacagtaaaatatttccaggatgctgatggatgtgaattagctgaaaacattacttatctgggtaagctgatacttgttgtattttttttttgttttttgttttttgtttttgagacggagtcttgctctgtcacccaggctggagtgcagtggcgcaatcttggctcactgtaacctccacctcccgggttcaagtgattctcctgcctcagcctcctgagtagcttggattacaggcgtgtgtgaccatacccggctaattttttttatatttttagyagagacagggtttcaccgtgttagtcaggatcatctcgatctccttacctcgtgatccgcccacctcggcctcccagagtgctgggattacaggcgtgagccaccgcgcctggccgatatttgttgtatttgtaatgaacataatatagtgttctcaggaattagtctcccaggaaatttttggctagatttttcagtgattgcagcctgagataatggggtttggagggttttttcccagagtctgtatatgtgctgctgtgcccttaggacaatgcctttaggacagtggcattttttctttattatttctaccacttagccccaatatcgttgcgttcccacaacccggtacacacttgtttagccaactggagggataaactccttgtctatagtatatgggatacttaaggtataaattatgttcacacaaaggaaatttcatgtatgtggctttaccatacaatcttgctaggtatatacagcttacttgttaatgagcctcccaactatttatagctctaggtttcactctaaggttttggcaactcaggtttttagtgctgttctttgggggctttttactctttttttactctcctttttctggttctaggtacactcttcagttccagcttaaagttgtttcctccacagccctctgtattgcttttagtggctctttcaatgtctggctgttttcaaaagcactgtcaaattttgcttttgttttccccccacctgctggcagtctgctgcctcttagatcattcaactcttttttttttttttttttaagacagtgtcttgctctgttgctcaggctggagtgcagtggcatgatctcggcttactgcaacatccgactccctggttcaagtgattctcctgcctcagccttccgagtagctgggattacaggcacgcactaccatacccagctaatttttgtatttttagtagagacgggatttcaccatgttggccaggatggtctcgatctcctgacctggtgacccgcctgcctcagcctcccaaagtgctgggattacaggtgtgagccactgtgctcggctttttttttttttttttagttgaatttactattcttcacatttcctccttgttggtcttatttctctagaaaacttcttcatttcctttgctgtaaatgtcctctctctccttccccatcatagttcatcttggcctttagtctttatttggctatggccctcccgttaccagtcttattttgcactaatcctgtgggacttctttaagcaaaaattgaaggaaggactttatttgttttgttgttttaatatggaactcttcatgaatttgcatgtcatccttgtgcaggtgccgtgctaatattctctttatctttccagttttagtatatgtgctgctgaagtgagcactgtttagttttaactacacatatcagatacgcattttgaaattctgttgtagattttaacatgagcctgacttatgcagttcttggtatagtttgtagatttggattaagggcattactgtagatatttggcagccattttactatatgaatttagtgccaggaaaggaaagagcagctaaggtacttgggttatttctgtgaaatagattttttggatccagtaggaggatcaagcartgaacttggtagtgaacatgtgatagtgagcttgaaatactggtaggacatccaacatatagttggaagtgagagttattattattattttttgagatggactttcgctcttgttgcccagactgaattgcaatggcatagtcttggctcactgcaacctctgcctcccggattcaagcgattcttctgcctcagcctcctgagtagctggggttacgggtgtgtgccaccatgcccrgctaattttgtattttttagtagagacagggtttcaccatgttggtcaggctggtctcgaaatcctgacctgaggtgatccagctgcctcagcctcccaaagttctgggattacaggcattagccactgtgctggtccgagagttctttctagagtatcagtgttgaagagtataggctttggagagttggtcccataatgatgaaaaatagagctgagaagaggatcaaattattaaggaagaaatacaatcagaagggaagcaggttgatgatagtaccttggtgggtggggatggtatatcttcatctagggggtaggaacaaagacataaaagtgcttagaggactgtttgagaggtaaagatattgtcaacttcatggaatctactgaagataacatagtttcaggagaacattggcaaatatagggtgacctttaagagagtgatgggagagggaaactgattgcagggggttaaggaactaataaagtaggctgggcgtggtggctcacacctgtaatcctagcaccttgggaggtcgaggtgggcagttcacgaggtcaagaggttgagaccatcctggccaacatgatgaaaccccatctctactaaaaatagaaaaattaactgggcatggtggcggtcacctgtagtcccagctacttgggaggctgaggcaggagaatcacttgaacccgggaggcggaggtggaggttgcaatgagccaagattgcgccactgcactccagcctggcaacagagcgagactccatctcaaaaaaaaaaaaaaaaaaaaaaaaaggtaaagcacttagcatggatgactcttcagaaattcaaaactgaagaggaggaagtttcttagtatgtgtgttcattttggatggcgatgattgagcatatttttttctgaacaaaaagcgccagctgagtagactcagtagatgaaagggaagtgaaaattgatggagcaaggtcttgaaggcaacaggagggaatggaaacaaggccacaagccaggaataaccatagaagagagtggcgtcttaaatttttcctaaacacttgttctttccaaatgttttccttcacttggaagttgctgcctgcctccaagtagctgggactacaggcacacgctgccatgcctggctaattttttgtattttagtagggatggggtttcactatgtgcatcttttctagactgtagcttccttagaactgtatttttcttcgcattgccttttcctgtstccagatgtctgcatttaagtccatgtagaatcttctctagaacgcagaaagccttttccctaatcttctcttcccaactttttccagtaatatttgtaaggcacctggcataaacatactggcccgtgggctccagcagcctccacgtagggctgttcatatttactgagcaggaatactgttgtagccattcaccattgatgcctagcagccagaagggagctgctggagagtttacacttcagacatgtaaaatggcagggacataggagagtcatgggagattcatccccctattgatggcttttcattctgcaattytgactaaaatttgttcatttttctttgaacccaggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtrtgtggggaactttgggaattcttctgtgagtagtgtttgtttagttggaatttctaaaagcaaattgcactggcttgagttgggacttttttcttttcctgtttatattgagtattttagctcttgggtaccttttattagaagtcttctgtgaaaattttcaggattctaaaagttctgtcaactgatcaaagcaaaagttaatttcatgaaagtgtgattcatagatgagactgctgaaatcttaattataaaggaatggttttttatattctctgcttcaagtgccctttcctaagcctcttaatgttttgaggcttcactgatttttttgttttttgttttttgtttttttttgagatggagtctcactctgtcgcccaggttggagtgcagtggtgcgatcttggctcactgcaacctcctcctcccgggttcaaatgattctcctgcctcagcctcctgagtagctaagattataggcatgcgccaccacgcctggctaattttttttttttttttttgagatggagttttgctgtgtcacccaggctggagggcagtggcgccatctctgctcaccacaacctctgcctcctgggttcaagcaattcacctgcctcagcctcccaagtagctgggactataggcgcacactgccatgcctggctaattttttgtattttattagagatggggtttcagcatgttgcccaggctagtcatgaactcctgagctcagacaatctgcctgcctcggcctcccaaagtgctgggattacaggcggatttttttgtatttttagtagagatgggatttcaccatgttggccaggctggtctcaaactcctgacctcaagtaatttgcccacctcagcctcccaaaatgctgggattacaggcatgagccaccgtgcccagcctaatttttgtatttttagtagagacagggttgcccaggctggtcttgaactcctgcgctctagtgatccacccgccttggcctcccaaagtgctgggattacaggcgtgagccaccatacctggccagattttaatattttatgagtaatcttgaaaaggatggtacaccaggagtgacaactatcatggggagtgaaacrctacactggtggaagtaagcctaaggaagattttgaaaaggttatgtgtgagggcagaaaacactgggtgagcttcattgaagggaaatgtaagaatgcatttsggaacaaatctccatggttggattcaggattatcagtgatgatccagaagtggagcctgtataccaccccttgccagtttcagcaccatgtgtccatgaccaaaaaggccaacaggataccaggcattatcaaggaggatgctctcttcctttttgacaaacccatgattactctttacgtagaatacaaggcatagagctggttggagcacaaggatatagcaaagctagggaagatcgagagaagggctgctaaagtgatgaaggaagagagaaagacacatatgatgctctgtaaggaaggatgakaaaatgaggcccctttgttttgcggggagctaaaaattgattttgatcaaggcttataaataaccatacagtatatttatggaggagaaaagtatagttcaccagtccctaagatgctaggactgacctcaaagctaattccctgcccttcagcagaaacctgaaggaaacaagcataagacaaaaggaaattcctgctttacgtagtggaaaacaaactttgttagcttatttccaagtaataccttctcttagaatagagttcataaataatgctgtgggtgagagatcacttaattggttgttaacagaatctggggatgttctgggagcaagaataactttgagcaaacttcatattacttaagaagggtgtggttatgcccttcctcaaactgccacttccttgactgaagcaaaataaaggattatatgctggtgatgaagtccttgaatactctataccagatattctgtggatcctaggagccctgaagcctagcttttcgctttgattttctgaattgactatgactgtctggacccgtgaactacagatgcactacgtaacaaactagaggctgggcgcagtggctcacgcgtgcactttgggaggctgaggcgggcggatcacgagatcaggagtttgagaccagcctggccaacatggtgaaaccccgtctctactaaaaatacaaaaattagccaggtgtggtggcacgtgcctgtaatcccagctactagggaggctgaggcaggagaatcacttcttgaacccaggatgcagaggttgcagtgagccgagattgtgccactgtactctagcagcctgggtgacaaagcaagactccatctcaaaaaaaaaaaacaaaccaaaactagaagcccagtctgtgggctccagagggagagcttactttccaaaaaaggttttaataatttgtgttttgggtattgatatggaggagttaccttttaatctctggcttccaacagttgttcctatttctacattcatagtagttcagctcccttatttgttaagattttttctctgattgccatacttatgaaattcaatgtgcagttccttctgtccacatctgtattcatgtataaatttcaaagacatttcaaaatgtcttattatttatttgcatttcttgataacttttggtctgtatggatgactaagtttttgtttactagggagaagtggataccaaaaaatgtggttctgctttggtttccagtcttgccacgggcttgaaaccaagataccattttgctgctttggaaaagacctattatgagaggcttccatatcggtgagtagcatttcattcttcttggctttttgaagaatttgccatggatcttctgtataaacttctcttgttcgtttttaaccatataacatcttggttccatttggttactcagacactgaagtaagtgactctcaagtcattcatcttctctgagtttgttccctaatttgaaatcactttggaaatccttcagtttcagaatcaagaacttgtatcagttttttccttttcagggccaggcatgatggtgtgtgtctgtggttccagctacttggaaggctgaggcaggaggctcgctcgagcccaggagttcaagactatagtgtgcaatgactacgcctgtgaatagccactgcactctagcctgggcaacatagggagccccatttctttaaaaaattttttaccacaaataaatatgagataatgtatatgttaattagcttgatttagccatcccacagtatatacacatttcaaaacagcatgttgtatacmataaaaaatacaaattttagttatcaattaaaaataaatgagagggaaaatttaaaaaatttttttttgtcttttttttttttttgagacggagtctcgctctgtcacctggctggagtgcagtggcatgatctcggctcactgcaacctccgcctcctgggttcaagtgattctcctgcctcagcctcctgagtagctaggattacaggtgcgtgccaccacgtccggctaagtttttttgtatttttaatagagacggggtttcaccatgtcagtcaggctggtcttgaactcttgatctcatgatctgcccacctcagcctcccaaagtgctgggattacaggcgtgagccaccatgcccagccaagaaaatatttttttttattttttttcttttgcactcagaggtggagtttttatttttttaatttttgggggtacatagtagcatagtaggtatatagaggtcaagttcttttttttgagacagagtcttgctctgtcgcccaggctggagtgcaatggcatgatctcggctcactgcaacctccgtctcccaggttcatgccattctcctgcctcagcctcctgagtagytgggactacaggcgaccgccaccacacctggctaattctttrtatttttagtagagacagggtttcaccgtgttagccaggatggtctcgatctcctgatatagaggtcaagttcttaaagaatatactgccaagaaaaccagtgttttacaagtgagagagttaagtaaaagctcagaattatcttcactgataaagggcatggattatccctaaaataacttctttcccttcttttttacaaaagtaatatttacgtgttgctagttaaaaaaatttaagtgagcaagaagagaataccccccttaccataatcccacagcctaatgcagaatcataggtaatacaggtttttctgttaaatctccatatactyattctagaagaatgtcttgttctctaaaaatatactgcgaaaacagaagttttgggaacaagccactcaaaacttacacagttcttaagaatcggaatacagtttttcatagaacatataaaaatggccaatagggctgggtgtggtggctcacgcctgtaatcccagcactttgggaggccgaggcaggcagatcatgaggtcaggagatcgagaccatcctggccaacacggtgaaaccctgtctctactaaaaatacaaaaaattagctgggcatggtggcgggcgcctgtagtcccagctacttggaaggctaaggcaggagaatggcatgaacccgggaggtggagcttgcagtgagcagagatcgcgccactgcactccagcctgggcaacagagtgagactccgtctcaaaaaaaaaaaaaaaaaaaaaaaaggccaatagacatataaaaagatgctcttatcattagccattatggtaatgyaaatcaaaagcacaatgatacaccacttcatacccactaggatggcagtagtcaaaaaggcaaatacataataacaagtgttgacaaggatgtggaggaattggaatcctcacacattgctggtgagagtgtaaaatggtgcagccgctttggaaaactgtttagcagttcttgaaaggttaartgtaagagtcagcagcatggtaacggcaattttattcctgtcccaagataagggaaaacatatgtccacacaaaaacttgtacacagatgatcataatagcattattcataatagctcaaaatgcaaacaacccaaatgtccatcacctggtgaatgggtaaattaaaagtggtaaatatatgatgaaatgttatttggcaaggaaaagcaatgaagtactgacatgtgctacaacatggttgaaccgtgaaaactttatgttaagtgaatgaagccagacacaaaggactacattttttttttttttaattttttttttttgagacaagatctcattctgtcttccaggctggagtgctgaggtactatcaaggctcactgcagcctcaacctcgtgggctcaagtgattctcctaccttagcctcctgagtagctgggactgtaggtatgcaccaccatgcccagttaattaaaaaattttttttgtagagacagagtctcactgtgttgcccagggtgttctcaaactcctgggctcaagcagtcctcctgtctcagcctcccaaagtgcctggcctattttagctttttattacacaaaagaagaggcaatagtaaagtgaaacctcatgtgtccatcacttagcttgaactattgtcaacattttgccaattttacaactcttttaaagccaaaagttggagttttgatggtttctgaagacataatctcatctcttcctaaaacagccttgtgaggtagggattgttgccctattagacggatagatagtaacttatctgaaatcatttgactggcgatgatgaactgaggacctctgctctttttatggccccatagagtccacatattttgtcattgcaaatcaaaagtaaaattgtttgcaattttttgtctctcaaatatgttgtagaaaccatatcattctacaggaaaatgcacagcatgccacccggtttatagctctggcaaatgttggaaatccagaaaagaaaaaggtaaagatttacctatttggtggarggttgatattcatggtctgcctgataaatgtatctcttgtccagtttagcattcagatcttctcttctccctgactgcaaggtctcagcagtttcggagactcctttgtaaaggtatggtaatgaaaggtcaagtctctttgggtctttttgtaggagagtttaaagaagggtttgggaaaataggcccagaggaataaaggcaaaatatcaaatgaacagtgttcctttacttccacatctatgtggttgtctctatgggtatttgtgaatttgccctcagatgcttgcttacttctttagcaacttcatttagctgaaataagaaaaccccaaagagctgggcatggtggcccacgcctgtaatcccagcactttgagaggctgaggtgggcggatcacttgaggccaggagtttgagaccagcctggccaacatggtgaaaccccatctctataaaaaataaaaaaaattagccaggtgtggtggggggcacctgtaatcccagctactcaggaagctgaggcaggagaattgcttgaatgtgggaggtggagactgcagtgagctgagatcgggccactgcactccagcctgggtgacaaagtgagactctgtctcgggaaacaaaaaaaaagaaacccagaggacttacctaagctctccttagggctaagatttcctgagggaaatcttagtgatacctggaatctatctttgtattggaaaacagtgcagttgatgaaaagaatataccagaaaaataggttgtttttctcacttctctgagagtatttctgatttcccagggccaaaactaacctattgtggattgagacagctaaaataagaacagttagtgaagtgggaaaataggcagataaagagtctgaagattattccactatcacatgccatagacaatgcatacaaaagataagcaaatcgatattttgtttttttcataatatttcaagctttttttgggggagggggcggatctgaagtgattttgcctttatttccttcactttaagccaatcatgaaatttcatagtgatttctagggttggggcagaaggaagacagtgttaagaatcatcagggctgtggcccagttggcctgcggaggtgcaggcagggtggcccctcaggggcagctggaggagcatggactgccccgctggcagggagctgatgttcccagagtataagagctggaatgtgatgtcctccacagcttccagcttgcgcagctctatcaggctgttccctgcggtggccagtgagttggcgatcagctctgctgccttggaatcgccctcagcagagatgatggctgcctttttctgctgctcagccttttctgccacaaatctggtgctctctgcttcccgctgagccacctgtttggcttccactgcttctgtgaactccttcccgaaggtcagatgtgtcaaggacacgtcatccaggatgagcccaaaggtggctgctygctctrtaaggtcgttgctcatctgcctggagaccagctctctttaggtgattagttctccagcatcaaagtgagccaccactgacttgaggatctcagtagtgatggacagcagcacacgcttatcataatcctcttcaatgctggtcaagatgcgaggaagctggctagcgacaggcccccatgtgcaccgtgatgttgacattctgtaaatctttgctatcagtgatgactggcacattacatggtcaagaacagcagtcaaagataataggtttgtgtacccatggaatgagaaagtgagtcccttcccstaccacagtgttctgtactccatggaatcggtcaaagatgacagctctttgctcagcatccacattatatagggcagagttcaccacgtctcctgcaacagctaaggccaggccaaacttgccaacggactcaaaacactttggcagccatgttttcttctgctggaccctttcatacctgcttccactctgacctccacataaattccccagcctattttcagcttttttgcccaattcttagcaaatgtagatttgtaatttttcttttaattgccctttcaaactgaataacacttagtattttcagtctgttttattctcagggacatgttagcctcagccataagcaacttatactttcgtcaaaaggtgtgcacattataaaatttggcaagcattgttaaattcatctaaaaactttgttccaatttatacccctaccccagcagtgkttttttttttccccctccatatttctcactggatcaagtcaaagtttttgtttgtttgtttaagatggagtctctgtctattgcccaggctggagtgtagtggcacgatctcggcttactgcaacctccacctcccatgttcaagcgattctcctgcctcagcctcctgagtagctggaactataggtgtgtgccaccatgcctggctaatcttttgtatttttagtagagatgggatttctccatgttggtcgggctggtctctatctcctgacctcaggtgattcgcccgcctcagcctcccaaagtgctgggattgcaggcatgagccgccacccccrgcccacgtcaaagttttattaaagtttttgccaatgtgataaatgatatataattgttacttagttgcatttccctaatcagtagtaagtttaaacatctatttatatcttatctaaagttttcgatatctgtggcattagtgcaagattccaaatatttatatgaatatttattgctttactgctagtctcctaagaaaattttattagcatatatagcagaatttgtataatatcagagagagaaacactaagttcgtttgtaattttcattaggaaaaataaatggcagtgccacaattctgtggacagagtacacaaagataagggactcagagacagaagcagtttgtcttcaagggttatacagcaagtccctctgggccttgtagtgacagttgtcactattccattatccgagtgagaactcctggtttgtgagggtgggggctttgatttcttgttcatttctttgtcaacccttggtgagcccctgcagaggccactgaattggcatttgatttactgtttactctctgagctatggatgggctggttgctgttcttttaattttactgagtttcacatgttttctgtgaaatcttcacagtaaaataggttgattacagttgggtaaatagtatttcccctaatgtcattatgttctttttctctaaagtatctttacgcrttcagtattgttcccatgaagctaatggatgcagcagaactggtaaaacagcctcyggatgtcactgaaaacccttacagaaaatctgggcaggaagcatccataggaaagcaaattcttgcccctgtggtatgttctgattgagggttggcatttttatatgtgttcttttcctagttatagtttagtacataagacaagtttaatcgttagaatctaaatcttttttttccccttgggaaatcatgatgrtgtttagaaaatcttagtagatttcarctaagcttagtgttttttattgtagtttggggttaacagtttgatacattaggtctttctttgtccaaactggattcagacgtttggggttacagttttatttgtaaagtctttgtctaaagtgattatctgttcttagctctttaggcaaggctctagcagcttcatagcaatgtaatttgtgattttatgatgattgctagtaggaaaataagattcactctgaagaaattttcttaatagcagagttttctcaaattaattttttccccactaaagcaaggaatgtcaagttcccttactagcatgcacggtctgctttctcagacttttctttctttccaagcagccttctcatctcttaaggctgaattaggcttgtttgacctgtgaaattgtatgactacactatgtccctgttgagagaaaaaagaaaagagaatttaggtgggttcatgttctgctttaggcaagaattactttataacttgcattttaactcgtttttccaaagagatgaatttggcagtagtttggataagtgttgatgtatgactgagacttcaggcatcagaactgggaagatattttgcttccctagagtgtgcagaaaggactgagaagaaagataggtatggcatggcaggaatgttcccttgtatgtgagtggtcggctacttatctaaaggttagttgaataacatttaatcttctgcttttggccattccaggaagaatcagcctgtcagtttttctttgatttaaatgaaaagcagggaagraagcgttcatccacaggtagagatagcaaatcttctcctcatccaaagcagcctcgcaaacctcgtaagtacctttattccagaggtttcttctatgaacagtaactgttattttggcttttctttggaaagcagcattgctaagagagcctcttctggcaggggagaattgtgcaatgagtcattaggaccaacagtaaaaataaaatataaacatggccttggccaggtgtggtgactgcaccatcttatattcccactggcaatgtatgaaggtttctgcttttccacatccctgtcaacatttgttatagcaatagccagttttacaagatagctccctcttttcctgtctcataaataggtatggttctctaggggtgatgcttttatatacttcttggactctgtatttttagcccatctacttgagagtgatgagttccttttgctaattaccatttaaagcaattttctttgtcctaaaaaggcagtcttctgttgcttatatacccatattgggataaaagcgttgatattcttggccaggtgtgggggctcatgcctgtaatcctgtactttgggaggctgagccaggcggatcacaagttcagaattttgagaccagtctggccaacatagtgaaaccccttctctactaaaaatacaaaaattagccaggtgtggtggcacggtcctgtagtcccagccactcaggaggctgaggtggaagaattgcttgaacccaggaggcagaggttgcagtgagccgagatgatgccattgcactccagcctgggtgacagagtgagactccatctcaaaaaaaaaaaaaaagttgatattctttttatagcttcagattcagaaactagagctttatgaatttttatctagaattatgtaatgctggaaactgattcacactaactgtaatcccagcactttgggtggccgaagcgggtggatcacttaaggccaggagttggagaccagcctggccaacatggtgaaaccctgtctctactaaaaatacaaaaaattagcaaggcatggtggcacccacctgtagtcccagctcctcaggaggctgaggcatgagaatcgcttgaacccaggaggcggagattgcagtgagccaagattgcaccactgcactccaacctgggtgacagagcaaggccctgtctcaaaaaaataaaataacgggccaggcgcggtggctcacgcctataatcccagcactttgggaggccgaggtgggcggatcatgaggtcaggagatcgagaccatcctggctaacacggtgaaaccccgtctgtactaaaaatagaaaaaattaaccaggcgtggtggcagacgcccgtagtcccagctacttaggaggctgaggcaggagaatggcatgaacctgggaggcggagcttgcagtgagccgagatcrcgccactgtactccaccctrggcgacagagcgagactccgtctcaaaaaaaataaaataagaatggcctgacttcgaggctgttctgaggcgcttcctgtactatggaaaaagcacctttcctttgtgtctgtaaaacataatgaggtgaagagcctccaaaaccaatatgggttcataaaataatagaatgatcaaactcgaaggaaggactttaagagtgtttcattgagattctctttcttcatctttttgtttcacacaagaagstgaccttgggagggtaaattttccagggtcatggctaatggcatagctggggctttaattggggctcctgacacccagttcagtgttcttttgttgtagcctattgccagttatgtgctactttagtcagtgtgtgattttgcacttgtgggttacctacctgtggattggttacaaattctaatggaagtttaatttcattgaaaatgttcatagggggtcgtagtgaggagcacaggctcagcccattgtggcagtgttgtataccagtcttttcaggatataaaaatcagacaaagctgagttctgtggggtgattatatgctstagtgcttggaccatagtaacacctggctttcttttacatgaagctcagcctccaggaccctgctggttttgccttgctagccctgaagtggaaaaacatttggtggtcaacatcggcacacatgtgagttacttccttggactttatagagaaggagatgcctatttgttttttattaactttattgaggcataatctacatataacatttacccatgtttaagtgtatgattcggtgattttcgtaaggttactgagttatgccaccatcacgtggtatagttttagaacatttttatcattgcagtaagatctcttatgcccatttacagttaatccctgttcccaactttagcctcaggcagcaactagtctacttactatctccatagtttgccatttttggacatttcttataaatggaatcatacaacatgtggtcttttgtgtctagcttcttttacttagcataatattcttgaggttcatccatgttgcagcatgtatcagtatttcattcctttttattgccaaatcatattccagtgtatagatgtaccacatttcgtctatatctgttcatcagctgatggacgtttgggttgtttctactttatggctattagaaataatgctcccataaaatatctgcatgcaagtctttgtgtggatatagacctaggaatggtctatatkttggatagacctaggaatggatttgctaggttatatagtaaatttatgtttaacttttaagaaactgctaaactgttttccaaaatgactgcaccatcttatattcccaccagcagtgtatgaaggtttctgcttttccacatccctgtcaacatttgttatagcaatagccagttttacaagatagctctcttttcctctctyataaataggtatggttctctaggggtgatgcttttatatacttcttggactctctgtattttttagcccgtctaattgagagtgatgagttccttttgctaattaccatttaaagtgattttctttgtcctaaaaaggcagtcttctgttgcttatatacctgtattgggttaaaaatgttgatattctttttatagcttcagattcagaaactagagccttatgaaatttttttttttttttttttgagatggagtctcgctctgttgcccaggttggagtgcaatggcrtgatctcagttcactgcaacctctgcctcccgggttcaagtgattctcctgcctaagcttcccaagtagctgggattacaggcacctgccatcacatctggctaatttttatatttttagtagagacagggtttcaccctgctggccaggctggtctcaaactcccgacctcaggtgatctgcccgcctcagcctcccaaagtgctgggattacaggcgtgagccaccacccccggcctatgaatttttatctggaattatgtaatgctggaagctgaktcacactaactgatcacatcaaagataaaatttcagttttgcttagtagtggagggtgtagcttactaatgacaggaatacccatattcacactcctggtgtgagtatctaggaacccaagatgatgatgatatggttgtttggtaagcattgaatcagactatgagaacgggatggtcttgagtatgattttattcaggtggtggaaagcttgaatgtgtgtgtctcatgggaaagtcattctatttcacatttccccagatacttttgcttgggtagggctggattagacattaaataataccagtgtttgastctgatttccctgggttttctgtagaccattgttctttttcattcatttagaatgaagaaaacttaatttttaacactatagtcaccagtgactagaattggatgttccccaagattcctgaggaaaatatttataagtcatttttgttttgtgacagttttgggaggtggggcctaataagaggtgatttggtcataaggactctgccttcatgaatggattaatgttatcacagtagtgggttatcatgagagtggctttgttaaagtgagttcaggtccccttttgcttctttactctcaccctcacttgcccttctgccatgggatgatgcagcacgaaggccattgccaggtgccagtgctatgcacttcgacttcccagtctacagaaccacaagccaaatagatttctattcaaataaattatagtctgtggtattctattatagcaacacaagatggactaagacaattccttaagtgtgtagtgcttctgaagacaggtgccttcatccatttctcattgatttgttctacttttggtttctggggttgatcstttcaacttatcctaacaatctgaggaccgttttttgtgtcttccttcctgtagactgactagagtctcaatttcatcttacactttaaggagttacacttctgcctgtgttgtttccacctgaagagtctcagtcttttacattttaaaaaatgtcttggccgggtgcagtggctcacgcctgctcacggctgtaatcccagcactttgggaagctgaggcaggtggatcacgaggtcaggagttcaagaccagcctggccaagaaggtgaaaccctgtctctactgaaaatacaaaaattagctgggcgtggtggcgggcgcctgcaatcccagctactcaggaggctgaggcagagaattgcttgaacctgggaggtggaggttgcaggccaagatcgcgccactgcactccagcctgggggacagagcaagactctgtcacaaaaaaaaaaaaaaaaaaaaaaaaaaaaggcttaattagtggcacactcctgtctctagggggagcactaatgaagtcaaggccggtgacacaactgagccatagaacctgtggatgaagtcttcagtggaataagagcaaacttgagaagctctagcttttatagcagtgccctttttggatgatctcttttgcatcttttttcgtctttggattagtttatgctatttttctctcccacacaatttgtatagtaagttaggctttgaattgccttctgtttgggaagcttcaataggttcaagatcacaygcaggagataagagatttggaatgtgtgacatagctcagtgctgctctaggcctcagtgagaagtgacttttcttttccattcatctttctattgtccaggttactctaactcagggtgtgggcctgggcaacaatcaaggaaacctgttttcttctcatctaggcctgaaactagaggggaaaaaggtcttgtttgtggcccaacccaacatcccaagtaggccacatgagtatttcagcctagagtctacaytgtccttaggtagaaacctcttacaaacctgtaatgacctttgggtgtctgtggaagagtttgggatctcctccctgcaattattctttttgattgcctttttttgttttttaaattttttccctggctttctctttgtcgtgccttcctcaaaggtagtacatagaattgtgctgatggtccatagccacagattagtaaaaagggggaagggctgctgagagtgtaaaataattattgcaaaatcaatgcattttacttacggggagaaccatttatccaggtcctatttacacatggttagagataattctagtatagaacagattagaaggtgagagtttgaaagagagaggagattaggcaagcgtgaaactattcacaaaaattgcaagtacaggattagagatggtgcagaggagctctttagtttagacatcattacctaaagaatgcacatcataatagagaagytgatgtttatggcagtgaccttctgacaaaaatagctagacgactcaggcttctagagtaaccttttaaacaaatacaatataaagtggttattatacaaataaaaaaaagtttttagtgcctgtgaggttttcatcaactttagtcatctggaaaattaactttgtcaatatgctcagtcctctctgccaaacaaatcaaggacaatcatgctttagtatctttccaatacatatcctgtcattctgttggactttcttattatagatgagaagtgattccttccttcagccttaactttgagcccaccacactaagagcatagttggaataattttttattttttttccygagacagtcttgttctgtcgcccaggctggagtgcagtggcacgatctcggctcactgtaacctccgccttccaggttcaagcaattcacctgcttcagtctcccaagtagctgggattataggcacgtgccaccatgcccagctaatttttgtatttttagtagagacggggtttcaccttgttggccaggctggtcttgaactcctgacctcgcgatccatttgccttggcctcccaaagtgctgggattacagtcatgagccaacgcacccggtctggataattgttttctaamgtatctatatttgcctgtactggtactcattgggcccttctgtgctcactcatggcatcttcccatcagagaatatctgagtggtagaccattcttgcatgttttggtttttacagaaatatttttagttgccattaaaggctgacatccattgttggaaatcattcttttctgcctctttggatgcatctgagtttgaggttttactttccttctaccccattaggttgtatgtttgcttttgttttgtagaatttagtcagcagsttaaggcttaggaacattagatgctaatcatgccatcttagctttttttgtgagcccaaggagtatattcgggggtgggggtgggaatgaaagttactggggaggcagaaaggggtcattttttttttttttttttttttggagacggagtctcgctctgtcacccaggctggagtgtagtggcgcgatctcggctcactgcaacctctgcctcccgggttcaagcaattctcctgtctcagcctcccgagtagctgggactacaggcacatgccatcacaggcctggctaatttttgtatttttagtagaaatgaggtttcaccatattggtcagcctagtctggaacttctgacctcaggcggtccacctgcctcggcctctcaaagttttgggattacaagcgtgagccactrtcccagccgaaagtggtcattttgaaatcagaagttgtatctttttgtggttgagggtgataaaaactgaaaaactgttttcaagtttggagcatgggagggaaaacccagcgatttgttctggtctccctcagctcagtgtgtttgaagccaaaagcctgcttgtgtgcctctcccaattcatttgctcctagttcatttgctacttgcatagaaattttcatgccgaatctcactcttcagcggatacctgagaacattgttgctacaatctctaaaatcagattttttcaagaaagaatttttattaataacctcaagtacttttcgcctacaccctcaggctcactttttgtataggyttttctccctggagaatcctacatgctgtattgatgtctcaattctgtgtgctgcttcttcagtgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtaggtggtctgttcatagaaacttggaagggcgctatggggactttgatattggtaaataagtatttaaataggctgggcgaggtggctcacgcctgtaatcctagcactttgggaggccgaagcggttggattgcctgagctcaggagttcaagaccagcctgggcaacacggtgaaaccctgtctctactaaaagtacaaaaaaattagctgggcgtggtggtgcatgcctgtaatcccagctactcgggaggctgagacaggagaatagcttgaacctgggaggcagaggttgcagtgagccgagattgtgccactgcactccagcctgggcaacagagcgagactccatctttaaaaaaaaaattatataaagtttagctttaatatgtaaaatatttaatatttttatattaatatttaaataacattcatttaaaaagtttttaaagagtatctggtggtaaccccagagacttcacagggaagtgtgtggtcagtacatgtaaacagcatagatagtaagttccttgtttagaaaaggaatgggtagttgaggaagttccaaggaagatgtggggcttgctggataagaatttggaagaaagtgagtattttgtgtggaggcccagcatgagggaaagcttagtggtaggaaatagtctcaaagcctgcatggggctagcagctcagaaaatcagattgtaaatcatttgtagttgtggtggttttctttttggcacatttgttaagttttcaaatgggcctaactctgccacatatataatatcggagatggcaaaggcttgtgacggagatatctctcttaagcctttcctgcatcagagaatggctcccacatgtgtcaggctatctcataagtttaagtccttacagacaggctgacacaggcttgtctggcctgaggatattctgtgctgaggggtgtttctccacccctgtgatggatttgctacttctcagagactrtgcaggcacaacttctctgggacctgcacaaggaatttctcctgtctccccaacccccaggtcattcctgtcccaatcagctgctctactactgatgacattaaagatgccttcattacccaggcacaggagcagcagatagagctgttggaaatcccagagcactctgacatcaagcaggtgaaacaggggatggtgatattcagggaagagtaaatatctgttttttttgttgttgtttgttstttgtttgtttgtttgagacagagtcttgctctgttgcctaggttggagtgcagtggcatgatcttggctcactgcaacctccgccttccgggttcaagtgattctcctgcctcagcctccccagtagctgggactacaggcatgcgccaccatacctggctactttttgtatttttagtcragacggggtttcaccatattggccaggctggtctcgaactcctgaccttgtgatctgcctgcctyggcctcccraaggtattacagkcatgagycacccacgcctggcaagatctggtttttgacatgttgagcctaaggtttttgacatgttgagctatcaaggcattccaaaaatgttattaaataggcaatgggttgggcatggtagctcacacctgtaatccaacactttgggaggctgaggcgggaggagcacttgaagccaggagtttgataccagcctgggcaacaaagtgagacaccttgtctctacaaaaaataaaaaaataagcttggcatggtggcatgtgcctgtagtcttagctactcaggaggctgagagtcaggaggatcacttaagcctaggagtttgaggatgcagtgaggtatgattgcaccactgtacttcagcctgggcarcatygcaagaccctgtctctaaaaaaaaaaaaaaaaaaaagaggcagtggacaatttggaactagagcactgggtattgactagactggagatgaacagggcattactccaaagtttagtgctttcctgggaagagcaagaaattagaatttcctaaggtaggaacttagaaggatagacgccactgggaggatattgttagtatcttccagttagactttttaagccctagttccactaagtggcttgggatctatagcaacatacatatctttttttcttgtgcatttagactgaattatttgcctagagatgaactcagattatagatttttaaagcattattggacatcctcatacaactctgtttactttagattgcacagccaggagcagcatatttttatgttgaacttgacacaggagaaaagcttttccacagaattaaaaagaattttcctttgcagtttggaaggtatgtttttcttcttttcaatgtattttcactagacctgctatgaacagagtggtgggctacatgggacaattgataaaaagctaaattgtaaacagtccttgccccagaggacccatggtcttagggcagatgtttwcatatatgacagtaatgtaatgtagaatgtgaagagtaccatgacagagttttggagaacaatgtgctgtagaaattcagaaaagggacagctcatttctagttggtgaaagccttcatgaaagtggcaaagttgaacctgagaggcatatttagagggcaaagattgaggtgagggcattctagccagaagtgctagggaactttaattgagcacatactctgtgccaagaactgtaccaagaactttacacatacatgactcatttaatcttcataactctgtaaggtaggtactgtcatcccgatttaccagtgtggaaaatgaggctctagagcagtgcccggtagacttttcacaacgatggaaatgctcaaatatctgcactgtccaatacagttgtgactagccacttgtggccmctgagtgctgaaatgtggctaatgtgactgaggaactaaatttttgattttatttaattaattagaatttaaatttaaatagccatacctggctaatggttaccccactrgatagcaggctgtagagagcttaggtagcttgtcctagtcacacagtggtaggttcaaacccaggcctgttggacctcaaaacttgaggtcttaacctcagtgttctacagtatggtaaaggcctagaggaggcttcagttctgttcctcgtatcaggcaaaacatgactgcaaaaccatagagggagtaacataacttaagcaaagattgaagatgggaagttgctggcaagaagatacagtttgaaggggagtggaaaatgtgtagaacrgagtatctgatgctggtgtctgtgatttgcagctgttttttctcccctagttaaaaatgggctttgagtgagccttgaacctgtcttggactaattcagaaagcctccaagagattgcccccttagataagtccagtaaatgtagttgtctacatttttcaaaaagataaatgggaacaagtgtgctacgagattcagacatctgacgtgatgttttcgttgttgcctcagcaacagatgcggttatgaacattgacaacataagcacacgattgcagatacacataggcgtataaagcacacaaaaagaagattctctgaatggttttgtgcttatgatgtattttcaatattgagtaattatcaagatactaatttatagttatatagcattttatagttaacaaaatatttgaaatggcatatttttttcagctgtacaagaaaggtagttctattttccttttatatttgaaataggctcaaagtttgcccagggagcttaggttctttgacttatagagaattcatgatttgtttctaactcttctatttactgtaacttcaaagtggaaaatgaaccatataaatgtgtaatagaattatttctaatatatcaaaataagtaaaaataaaaatataaagcaatggcgattagaaggcagcttgtgtgtgagtgtgtctgtatgtagttattctttagtcctaagagccaagatagttgttttgttgacattgggcttgtgctgctgttacgtgggcctgagtyccctagaaggagaggcagaggaattttaaatcagagtgggtatgactaggctcctgactctgcaaactcatgtctagttgaggtgacaaaactacagtttaaggcaggttgtaatcacagctaatatggcactttgactgtgttatctctgtacctcacaaaaaccctgtatggtgggtgttcttatttgcatttcataggtgaggaaatcaagactcagagatgaaatcatctgtctagatcatagatagcaagtggcaaagctggaaatgggatccagtctctgatctttctcacaccagggcctgccctttttctatgtggtgttgcttctctaagtaccaataatatagttccaagttttttaagagagggagaagcaagtggggtttgaaggatcaggaaatatatagtacctgagctggtcatttaaaacgggtatgattttgatcaatagtatggcagagatggcactcagggcaggagagcaaagtcagagaaatttgcatacctcctttgggtgatgttgaggagagctcaggctgatagtttccattttgacttctttgtgctatttctgcagggaggtcctggccagtgaagccatccttaatgttcctgataagtctgactggaggcagtgtcagatcagcaaggaagacgaggagaccctggctcrccgcttccrgaaagactttgagccctatgactttactctggatgactaaaacaaagggaagaactttttatgaactccacaggaagtagtaargcttttttttttttttaattaaaagaattttttttgagacaaagtctcgctctgtcacccaagcaggattgcagtggcataactgtggctcactgtagcctcaacctcctgggctctagagttcctcccacctcrgcctcatgagtagctgggaccacaggcgcawgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcrcttgtartcccrgctrctcaggaggctgaggcrggagaattgcttgagcctgggaggtggaggttgcagtgagccaagatcgctccattgcactccagcctgggtgacagtgaaactccrtctcaaaaataaaagaataaaagtatgtctgtcatccagctcctatgtctgttatccagctccaagtacagcttgtgtatatcaacattttcaaaaacctttaaactaccaaatgaaatccagatgtttttccatggttgagaagtgtcttgtgttcatgttgcctgtgaccgttgaaatgaagtagtatgtgtaatagcaggggctagagctttaggcccagctgttactccaaaatcacacagggcagtttctccctgaacaacccaaagtggaaaagggatccaaggcttttgctatttttctcttaaagcattcatcttattcatagataagagcccatttagtccttcggatatttaactcctatgtgccaggcatttttctaagctccaggaccatagtcatgtcccaatatggtccctgttgtcccagagattacagtttaatggggaatagaagggacagatttaagaaaaaaaagataattctcctttggatattgttttaggtgcttgatatatctaatatgtgtctgttgtgctgctgggcagttctaaactcatcagtacctgggttggttacagggctttggggatcatcagggtataggccataggtgaaattaagatagggtaaatacagtcctgagctgaagatgattacctgagaaatatcagtatttaaggagtgcttgaaaatagtgatctaacatttacatagagaaggagcaaagagaatgctacatattaggcgcaaaaagaaaaatatttttacctttatattgggcacttatggtccagacactgtttcatttaatcttcacaaaatctctgtgaggtaggtattacctctattttactcatgaaaaaaaaactgagactcggaaaattgaagattgtggagcctggggtcaacaggcttaggctttttaaaaaacaggccaggtggctcatgcctgtgattgcagcactttgggaggctgaggcaggcagatgacctgagatcaggagtttgagaccagcctagccaacacggtgaaaccccgtctctactaaaaatgcaaaaaattagctgggcgtggttgcatgcgcctgtaatgccagctactcgggaggctgaggcagtagaattgcttgaaccctggaggtggaggttgcagtgagctgagatcacaccattgcactccagcctgggtgacaagagtgaaactccatctcaaacaataacaacaacaacaacaaaaaacaactcaaattactcatggccctgggaatgggggcatttaaaaagttaaccaagggaaccaacctggtttccacaaagatggccacttctgggtcagcccaatcatcagtatccctgggtcctcagcatcccttcctacctcttttgactgggaattacgagattacagccccacctacggaaattgagcacattagcactggccatgctgtacatacagcaaatgagagggcttcatactgttacaacaatctgtaccacaattctctgtgcggtctgcccagctctaaatgacatgtcctcagaggcatcatcatctccaagtccatggaaaccatgcacttacagaaaccagaacctcccataccacatgttactaatgacctacaacatcgacttcgtctgtatcatgcagtgctcaacattctggttgcagcatcacatttatcaataatttgattccatgctgattcctttacttggagtattgagatcccccaggtacagtgaaggtatgaccctcttaaatggaagaccaggagttgtttcccctatgctatggcaatccgccacccggaagcacttgctgcaccaacagcattcccaaagcttgcctctgcagccctgtagcacccattagaaacacttctcacaatgaactactgtgctggcaaacccataactggactgccggacagcaagctctgtgaggcatctaggaaaaaagctcgcgaaatcccgagaaacactcttcactccggaatagcgtcacattcttgagtcatttgggatgacaggggatatcctggagcaggtgtattgggaagtcagtgaacaagaaggctaattcattagtgggcctgctagcgtagtattttaacgatttcgcagcctttaaatcattggtggtctttagcgtgccggatcagctggtggtggagttggaggatagatggcagggatctgaagaaaggtgaagtgtagataggagtagagacaatatgaagtttagaaaagactaattgctggacgcggtggctcatgtctataatcccagcactctgggatgccaaggtgggaggactacttgagaccaggagttcgggaccagcctgggcaacgtagcaagaccatgtctctacaaaaaataaaaaattagccaagcgaggtggtgcgcgcctgcaatcccagctactcgggaggtgagaagatcgcttaattccgggaggtcgaggctgcagtgagccgtgatcgtgccattgcactccagcctgggcaacggagcgagaccccatcttaattaaaaagaaaaaaatacaggagagactgggctgctttgaaaagtggatttgacgggaatgtggggtttggagagatcttatgttttccaagactagaaaaacattgtggttccgttcagccctcccggaaaatacgtaggggacttaaagagcggaccgagtacctgtttgtttccccatcccttagccggcagggctctggcagcgccctgggagaacttagggaagggccttctcgcagcggttaccggaagtgacgcattcattctcgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggtgaggcggggcgtgagagggagcggcggtgggttggagcggcggtgggtttgagcgtctgtggaacacagggctgacagtgtgggatagatggttggtgggaccttgggcagtatttgggggccagtgggcttgtgtgtgtgtattagagagaaagatactatgcctgtgtgtccaaagttgtatttgaggtactgggcatagatagagctgttgcggggaacttgggtatgactgtcaggctgtgaccaggtgtttagtgagtgtgacagtgcgtgtgtgtctctgtgaatgtggagtgtcagggtgtgtgaggcagatgcacgtcacagtgtgtatgtaggagcacgaatgtgtgagaagagggctgaaggggactgcctttgggaatgtgtgcgtccgtgtgtgtgtgtgtgtgtgtgtgtgtgtgtgtgcgcgcgcgcgcgcgcgcttggaggccatatgatatcagtggggactggagtagacaaggaaggcttcatgatgggtccagagttaagcctttggaagcatggatgggctttggaattggggatgtattccaggtcgggacagtatgagggtgagttggtgcagagcatggcttcaaacgaaaggctatattagtagatggagatggggggcgctctagtaggtggaggacagttaacatcagactcaagaattttactttgatttaatagagaatgtttaaccattgtagtagcagttaaaaaatcatatttgggtcttgtttgtttgtttttgtttttgagacggagtctcactctgtcgcccaggctggaatgcagggcgcgatctcggctcactgcagcctcctcctcccgagttcaagcgattctcctgccacagcctcctgagtagctgggattacaggcgcccgccaccgtgcctggctaatttttttgtatttttagtagagacggggtttcaccatgttggccaggctggtctcgaactcctgacctcaggcgatccacctgtctcaggctcccaaagtgcagagattataggcgtgagccacggcaccaggcctgggacatgtattttttgatataccgataaaagctgtgaaccctttccccagaaaaatgcacagatgcacattcacacaaccatgcattgccatttgagaggttcgtgccttcctaaaggacattttaggtaaatagaccctggactaataattcctgtaatataggctttgttttgttgcctgtaaagtaagtatagtataataattacatgcatcatggatttgagagttaaataaaatagtaatgtgtgtaaagctaaatacggtacctgacccatgaaagccctcaactgttagcacctgctgctactttgttgttgttgctgctatgatcataatgctcctcattaattggccttaaggaaatgtcaagataaaaagtgttgttctaggaaaatggttttgtaaaggataaatttgagtggaacaacatatgggacaagatgaacaggtaagatcttactaaaatgcctgggcttggcttgtgaatagagaagttaattcaagaggaaaagtaataatttgttatctaaaggaacatgggtgtagtgagaaagctcgtaatttggggtgggagaaaggggagataggagtctaccttgggaaaataggcatatttagggtaattagaatgacaactgaaactgttagaactgaggaagttttgtgaaccaggtttctagatagggcataggagaaaatcttggagaaagagaatggaaggtgaaggactaaggcattaagtcctgtgatagcaggataagtagtaaatttaataattctcaccatcagagggaacataacacactaaaaaaaaaaaaaagtgggagccaagtgcttccagtggcatgttgcctgtgttacctaagcctgcctatccgcctggtcataaggaaaaaggatgcatgctggcagcttttgtgacttcttttcttggtccctgggtggggatggatgaattaatcactttttgttttattatggtaaagtatacataacacaacatttatcactttatttttaagtgtacagttaggtggcattaagtacattgacgttgttgtacagccataaccctatctccagaatattccgacttttttgttgttgttgtacatctataaacttcccatagaatattctttgtgaaaaggtagaatttcacagagttgatgaaatataaattaaggagttgaaggatcttacaaagtgggatttttgaaatagataacttattgctccattaacatgagcattcagggctcagtgttgttcatggttgtgcctgattctcatttccatggtggtaaaggcctgcatgggacatagatataactggtcacctgctcataacaaaaggaagattgaagggagtgagaactgtgggtaggctagcatgcagtctatcctagtttccttcttctctatgcaccaggtatcatcttatctctagcttcttttttcctctcaccctccaattcacactaccctatccaagctatgtcttgcttccccacctataatatattttttctgtcctggcccctgggctcttctctctgtattcatacacagcctttattacaactctggtttgtgtcagagattacatatgttggaaattcttttgaactctccttgtgatatcagaaacatagtgtagcctgtttagccctgactgctatttctgagctgcattattaatgttgccagaatatgatggggtctggctatttcctgtaatatgcatcagaatgggtttaatttcagtcagaattggctaaattactagtcacaggcaagagatgttaggttcattatgtagctatggaagcagaagtacactcattggtaggattttttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacatta

SEQ ID NO: 12489 - DNA, 37175 bp, Homo sapiens
ttaaattccaagtggtttctggcatacggtaggaggatttttctgcccctttcctctgtggagctgagcaccagtggacaaacaggcacacctctttcatttgattattagtcttaatccttaaatttataaagttcctttcatgtttttaaatctcactgaattctcacagtgtccccttgaagcagactctggagtcagactggctgggttcaaatcctgcttcacttagctgagtgaccttgggcaaatcactttctctttctgtgcctcagtttcctcatttttaaaacagtgacaagaatttctggaggtggatattggttttatggggcctgaaggttacgatttggaggaccctctttaagaatagaatacacactcggttacggtggctcacgcctgtaatcacagcactttgggaagttgaggtgggaggatcacttgaggcttcaggagttcaagatcagcctggtcaacacagtgagacctcatctctaccaaaaaaaaaaaattagccagtgtggtggggcatatctgtagtcccaactacttgagaggctgaggcaagaggatggtttgagcccaggacttcaaggctacagtgagttatgactgtgttactgccctcctgccttgctctagacagagcaagactctgtctaaaaaaaaacgaaaaaaccccacacacaaaacctccccttagaccctgaatatttatatttatttgatcaatgtggtcaatgggaaccctttcaagctggtgtctgtgtcattttggcctgcttccataattcctggaacacttgctttctggtatagcaagatatcaacttttccagcccctggaatcaaccaatactccaaagagctctgatttaatcttttagtggaaaataatatttagaaagcatgaagtaggcactagaatcatactaaaaaaccaagaactggccgggcacggtggctcacacctgtaatctggactttgggggctgcagtgggtgagctgcttgagcccaggagctcaagaccagcttggaaacatggtgaaaccccatctctacaaaaaaatacaaaaattagctaggtaggtagtgcacacctatagttccagctactcgaaagactaaggtgggaggattgcttgaatccaggagggcaaggctgcagtgagctgtgatcatgccactgcactctagcctgggcaacagagtgagaccctgactaaaaatagataaataaataaaaatcaggcgtggtggctcacgcctgtaatccccagcactttgggagaccaagacaggcagatcacctgaggtcaggagttcgagaccagcctggccaacatggtgaaatcttgtttcttctaaaaatacaaaaatgagtcagacatggtggcatgcccctgtagtcccagctactagagaggctgaagcgggaggatagcttgaacctgggaggcagaggttgcagggagccaagatagtgccactgcactccagactgggcaacggagtgagaccttgtctcaaaataataataataataatagggctggatgtgggggttcacacctgtaatcccagcactttgggaggccgaggcggatggatcacctgaggtcaggagttcgagaccagcctggccaacatggcaaaactccatctctactaaacatacaaaaatcagctgggtatggtggtgcacgcctgtagtcccagcttttcgggaggctgaggtaggagaatcgcttgaacccaggaggcagaggtttcagtgagctgagatcatgccactgcagcctagactgggtgagacacagtgagactctttctaaaaatactaataataaataaaaataaataaataaaagaaaccacctgggcatggtggctcacgcctgtaatctcagcactttgggaagctgaggtggccggatcacttgaggccaggaatttgagaccggcctggccaacatggtaaaactgtctctactaaaaatacaaaaattagccagacatggtggtgcatacctgtaatcccagctacttgggaggctgaggcaggagaatcgcttgaacctgggaagcggaagttgcagtgagccaagatcccaccactgcactccagcctaggcgacaagagtgagactgcgtctcaaaaaaaaaaaaaagaagaagaaaccagaactgttcattgttatgagggtcactactcccagtccttcctagagctaatgaatgtgtacacacacacacacacacacacacacatttacaattatatttatttctataattatacatactaaacaacatgaattcagactatcatctccaattccaagctcatatcatggggttcattctagtttttgccccttgtgtatttatacttcctgtctttcacaccgaggaatctggtgtccattattcttgatttatcttttttttttttttttgagacagggtcatgctgtatcccccagctgctggagcgcagtggagtgatcttgactcactgcaacctctgcctcagggttcaagtgattcttttttttttttttttttttgagacggagtctcactgtcacccaggcccagaggcccaatctcggctcactgcaacctccgcctcccaggttcaaacaattctcctgcctcagcctcctgagtagctgggactacaggcgcctgccaccaagcccagctgatttttcgtattttttagtagagatggggttttaccattttggccaggctggtctcgaactcctgacctcatgatctgcccgccttggcctcccaaagtgctgagattacaggcatgagccaccgcacccagctttttttttttttttttttgagatggagttttgctcttcttgcccaggctggcgtgcaatggcacaatctcggctcgctacaacttccacctcccagattcaagagattctcctgcctcggcctcccaagtagctgggattacaggttcccaccactatgcctggctaagtttttgtatttttagtagagatggggtttcaccatgttaggcaggctggtctcgaactcccgacctcaggtgatccacctgcctcagcctcccaaagtgataagattacaggcgtgagccactgcacccagcctaagtgattcttctacctcagcctcccgtgtagctgggattacaggcgcacaccaccacacccaactaatctttgtatttttagtagagatggtgtttcaccatgttggccgggctgctcttgaactctgggcctcaagtgatccacttgcctcggcctcctaaagtgctgggattacaggcatgaaataccacatccagctactttttttttttttcctttgtttgagacagggtctggctttgtcacccacgctgaagtgcagtggcgtgatcacagctcactgcagccttgacctcccaggctcaagtgattctcccatctcagccttctgagtagctgggattacaggctcccactgccatgccccgctaatttttttttttatactttgagttctagggtacatgtgcacaatgtgcaggtttgttacatatgtatacatgtgccatgttggtgtgctgcacccatcaactcgttatttaactccgctaatttttaaattgttttgtagagacagggttttgctgtgttgctatgttttgcaagtgttgggattacaggcatgagcctccgcagtcggcctggatctgcttcttgttccacacataaacttgtttctttcactgctcacatacttccagttgtcctgggaatcatttatattgggataagacttctgatcctgtacagcaagggtcatgaggtacagcaaatggtaggaatattcctggaagccctttccacacaccaggacagctcacaatgacttaactatacacaaaagtgactgccagccacccagctatatcccaccaaatcaatccaaactgagtgtatttccaactcaacttcaccttagctggatcaccaaatcctcatggcatctctgatatcacctgattcaagggaaagtgagatagagtgggaagaaatagtagtcttaaccaattgcaattttagaattttgcttttgcatgttaaaagaaaaaaaaatatgtatttgacgctatgaagacattgctggggttgctcccagtgcctaggatgggcccgtgcaagtgcaaggccctgccctcaagagccctcagtctgagggagaagacacagatcaactccaggaatctctaatctaaagggagaagtctctagtctgaagtggggaacacgcaattccaaccaaaagagaaacctaaaggaaaaaaggaaagaagaaggcgtcaactgtgtcaaatgcacctgagaagttgagtaagataatagtggttcattggctttggcaatatgtagcactgtaaccatatcagagcctttaaaaaatagactagaacaggccgggcgcagtggctcatgcctgtaatcctagcgcgttgcgaggccgaggcaggtggatcacttgaggtcaggagtttgaaacgagcctggccaacatggtgaaaacccctctactaaaaatacaaaaaaaaattagttaggcgtagtggtgcctgtaatcccagctacttgggaggctgagaatcacttaaacctgggaggcagaggttgcagtgagctgagatcgtgtcactgcactccagcctgggcaacagagtgagacttggtctaaaaaaaaaaagaagaatagatagactagaatatactgtagagagatgggaggtgagggagtagaaaaacaagcaaacaagtttgctgcaaatgagagctgaaaattggagaggtagcagcagaagaaagtggggccatggaataataatataaaaacagggctgggcatggtggctcacacctgtaatcccagcactttgagaggctgaggcaggaggagtgcttgagaccagggtttgagacttagcctgggcaacacagactccatctctaccaaaaaacaaaaaacaaaaaacaaaaaaaaaaaaacagcagggcgtggtgatgtgagcctgtagtcccagctactctggaggctgaagtggggaagatggcttgagtccaggagttcaaggctgccgtaagccaagatggtgccactgcactccagcttgggtgacaatgcaagaaccccatctctaaaaacaaacaaaaagatattaaagcgtgtttgtaaattgaagggaagaagaaagatatttgtgatgcataagctaaaaaaagggataattaacagggatagagttcctgaaaagactaagatgatgagattcattgcacaagtggagggattagcttggatggctgggtcctgtccccgcattaacagaagtgaaggtcaatttcagcacctgtcataatttcctgggcccagtgcaaaatgaaaatgtgggtctccttattccaaaattattaagaatttcaagactataacagaaggccatgaaatcaagcgtggagcctttctaagcctgggtgctgtgcgactgcaatttgtactcccatgaagctggccctagtcaagtacgcagtgaggtcgatgaggaggaggctgtcctgtggtaagtcccttctaggattggaagagatgagtaaggctactttcagcttcactgctctacaagctgggggggtcgctagcaagggagaggggcaaaacttgtccctttttaacttccaaccctgccagatttgagtccagggctttctagaagtctccacggcatcgggtgaccatagcaactcatgccaaactctcgggcccacggctccgcctaccgcttcgtggacgcgcttgttgattggctccgaatgtcgaccaatggtcggcgaagcgggttgcttgccgcacggtcaatggccgcaaaccgggaggaaggcgggaagagaggaggtggaggcgggcctgggcagccgcgcgcgtgcgtgtttccggctccgctgcggaaggcggacgactagagtcgttgggcccggcgcgamccgcaggagsgtagagagcgcgggactagagtgcagagctccgggacgtggatcggagccggcgcgatgggcggagagcaggaggaggagcggttcgacggcatgttgctggccatggctcagcagcacgagggcggcgtgcaggaggtaacggcccgcgcggcgtyggcccacccggcggccttggccacgctccttccgcccttctctgccttcgagggctgagacccaccccagcggctcgcgggcttctgggatgcccctacattctcactgcgcccagcttccggcctggccacccgccagcaggtctcacccggttcgcatcagtcccgggcccccggcgcccctcagtagtagcaaattatcgcrtccctgagcttaggatccccctttagtttcacatatgcccccacccccgtttccactttgatggcggcttccaaggagcatcccttagtaagaaccgtcgcaaatatcgtgatttggatccaccaaggcttggggcgagccgtcgaatgtgtgtggtaggggagcgggctgatgttagcacgtggtcttgttaggccttgaatgggggaataggaggcctgtgttcacgattagtttccaccacctaccaacttggaacctttacatctctccaagcctgagtttccttatctgtgagacagctgcgaataccggtttccagagagtagttaagaaccgtaagttctcagtaataaggctttttcattcaacaagtatttgtcgtgtgattgatgtgtgtcccacactcgacaataagggccaactgttacagattctggagttggtttttttggaacaaacacaaagttaacggtagaaaagtctgtcaggatcagaactctcattctcagagccagagaagtggcaaggatttgcctagatcatgcaacatggttctcacctagacaggtcagtgtgcttcccagagtccatggctgattgtgtcttactggaggtaggtttccattgaactttctattcctatgtaacctaggtgtctggtgaccaaggacttctaagccctttgtggtggggagagtgtttctcatttgcaagtgtgaaaagccttcctgtctccattcctctaaactgttcgcacaaaactggatttgggagcgagttcatttttgagcaaattgaaaaactgtctagaagcaagaacggaaaccattgagatatgttctagcatcagatttaatcagatttagacccactcttgggcaaataaagggtttgtgtgtgctgaccttgagtcaccactagattgtttcattcagcaagaattttactgattatgtacctttagccatatctggtgcccagcattgcaggtggcagacagactaagccatggttcatggttcctatttgtaaggtgtttaccctctgccagtgggtctcttgctctgtgccatacattgctaaaggcctcacctccttgacctcatgatcctcaccaggtccctagaaataggtactgcatcttattcctgttgtacagagttaagaaacttctgcaaagtcaaaaggtaatatatgtccatctgatactcaaaccgttggctacacttgtactccagccagaattaatccatcttatcctcctttgaagtggcttcatttgctctcctccttcttgctttgacccggtaacttagccagtgtctttttttttgtttagacaagagtctctcacccaggctggagtgcggtggcacgatcttggctcactgcaacctctgcttcccgggttcaagtgattctctgcctcagcctcccaagtagctgggattacaggtgcccaccacctgtaatctagctaatttttgtgtttttagtagagacggggtttcaccatgttggccaggctggtcttgaactcctgacctcaagtgacccgcccacctgagcctcctgaagtactgggattataggtgtgagccagtgtcttsatgggctttttactttctggagaggaaagctgggcccaggcttttcatgccctggatgcagaggagtgttccatacgcttaggctgcttctagcatcacaaggaaagtgaaaggcgcacacacacacaggatatgagaaatctgcttcatggtggaagtgactaagagaacytgctggggagataatctcctcagttgggaagctcagaggaaaaatagtcaagtcccaagttccctcctagacaaaacaagttgacttgtgtgcagttgaagggctcccaaatgcagctctactactttaatcttctccccctctttcagcttgtgaacaccttcttcagcttccttcgacgcaaaacagactttttcattggaggagaagaagggatggcagagaaggtaagtgttggaaaccactgtcctttgggcggctctgtctcttcagaagaaaagctcacctggcctttctttggcataatagtaactttcagcagaagcgaaatgccaaaggtgaggaattggggaagggaaggaagctgtcatttcttcaagctccactccttgctcagccctctatctaccttatttcccatgacttttgcagttctacaagaggggcaggtgttaactatccccattgaggaaattggctcaagagaattttgcaccttatccaaagtcttgagctgagctgtgggagaaccagggttgaaaccagtctgttgtaaacctgtcctctgccccracacagtgcctctcagttccttttccaatgaggaggttttatttatttatttattttctgagacagagtcttgctttgtcacccaagctgaagcgcagtggcgcaatgtcggctcactgcaactttcgcctcctgggttcaagcaattctcctgcctcagcctcctgagtaagtgggattacaggcgcccgccaccacacctggctaatttttgtattttgatagagacgaggtttcatcatattggccaggctggtctcgaactcctgacctcatgatccacccgcctcggcctcccaaagtgctgggattacaggtataagccactgtgcctggccaggaggttttatttttacttttatttattttattttattttattttttgaaatggagtctcattctgttgcgcaggctggagtgcagtggcataatctaggctcactgcaacctccgcctcctgggtttaagtgattcttgtgcctcagcctcccaagtagctgggattacaggcaggcgccaccatgcctggctaatttttgtatttttagtagagatgaggtttcaccatgttggccaggctggtctcgaacccctgacctcaagtgatccacccacctyggcctcctaaagcgctgggagtacaggtgtgagccactgcacccggcctgaggaggttttaactaataacctaggagatgagactgggcaaatattagaaactgatgcttagaaataaatttagaaggccgggcgcggtggctcacgcctgtaatcccagcactttgggaggccgaggctggcggatcacgaggtcaggagatcgagaccatgctggctaacacggtgaaaccccgtctctactaaaaacacaaaaaattagccaggcgaggtggcgggcgcctgtagtcccggctactctggaggctgaggcaggagaatggcgtgaaccccggggggcggagcttgcagtgagccgagatcgcgccactgcactccagcctgggcaacagtgagactccgtctcaaaaaaaaaaaaaaaaaaaaaagaaataaatttagaaatactcagaggcatgtcttcccagatgctgtgactcagagtttaaggatttctgttttgtagtattgattctgagaccttgaacttctttctgattccttaaagttgtaattatacttttgaaaattgttatatcatgaggaatttttttttttttttttttttgagacagagtttcactctgttgcccaggctgcagtgcaatggcacgatctcagctcaccacaacctccgccttgcgagttcaagcaattctcctgcctcagcctcctgagtagctgggattacaggcatgcaccaccacgcctggataatatttgtatttttagtagagatggggtttcaccatgttggccaggctggtcttgaactcccaacctcaggtgatctgcctgccttggcctcccgaagtgctgggattacaggtgtgagccaccatgcccagccttttttttttttgagacggagtcccgctctttttatccaggctggagtgcaatggtgcgatcttggctcactgcaatgtctgcctcttgggttcaagcaattattgtgctcagcctcctgagtagctgagattacaggcgtgagccaccacgcccggcgccattatctttataatagacataaacaagagacataataagaaggagacgtagacgttctttgcaaaccgttttctgtggcttcaggattctaacaagttggtaaactctttaatgtgtcctgaatgtctgaggccactctgtcatagacamattacctaagagtaggagtcccaggttcttggtctagctttgtcacctagtcgagttcccagcaatgctctggttctttccatctttacatctgtaaaatgggagaaagtagaccccttctagctcagatattttttctgtattgtcactaacacctctggcctttctgtgggtcagactacctgtaaaacctcatgccgcaaacttacaaaaaaatacaaaagcacttttagtttttatagcttttgggactagtcatttattttttctttctttttttttttgacacggagtttcatgcttgttgcccagtctggagtgcaatggcacgatctcagcccactgcaacttctgcctcccaggttgtaagtgattctcctgcctcagcctcctaagtaggtgggattacaggcatgcaccaccatgcctggctaattttgtatttttagtagagacaggtttcaccatgttggttaggctgttctyraactcctgacctcaggtgatccmccwgcctcagcctcccaaagtgctgggattacaggcgtgagccactgcacccggcctacttttttcaatgaatgtttattgaacacttaacactttggattatgttaggtgctatatcaaaccttttgggattgcagaggtgaatacagatttgttctttgttttcatggatctcacagtgtagccaaaataaaaaaaacaagcagtgaaaaagtagtgggtgttggggcagaatccctgggaacataaaactaacctaggttgggggctcagagaagactttgtgaggaagtgacgcttcagatatgaaggatgaatagctgtaagaagggagagagatgaaccgtgtgtgtgtgtgtcagggtcttgctctgttgtcccagctggagcacagtggctgtaagaagggagagagatgaaccgtgtgtgtgtgtgtgtgtgtgtgtgtgtgtgtgtgtgtgkgtgtgtgtcagggtcttgctctgttgtcccagctggagcacagtggygtgatccagccgccttagcctcccaaagtgctgggactacctaatttttctttttcttttttttttttttttgagacggagtcttgctctatgacctaggcaggagagcagtggagcgatctcagctcactgcaatccccgcctcccaggttcaagcgattcttctgcctcagcctcctgagtagctgggattacaggcgcccgcccctatgcctggctaattttcgtatttttagtagagccggggtttcaccatgttggtcaggttggtctcgaactcctgagctcgtgatctgcccgcttcggcccctcaaagtgctgggattacagtcatgagccactgcgcccagcccctaatttttcttaactgtaagagggagcagtccttaccttacaaggatgttacgaggatttaaaaaaaggcaaagaccacaatccacttcagaatcccttggggccacatgtgttttggtatttaaaattatttggatttcagaaaggcaatacagtgcatataatgtgcattacatacaataatctaatcgcaggccaggagctgcatcctgcaacaaaacacattaatatttctgcagaaatatatatatcaatatacataccaagtagaagaaatgaagactgtaaatacctcatgccacgaacttacaaaaaaatacaaaagcacttttagtttttatagcttttggggctaggaattgtagacttgaatacagccatagtgatctaatcaatatggtattgatagaagaagagaaaaatggaccagtgaagcagaatagagaatcctgaaataaagtctggcatttatgaggatttaatgtgtctattgtggtaattcagttcagtaggcaaagcatgatttaataagtcatgctgctacatgaattttttttggttaaaaaaacaaaatttgccatctgtcatactctataaaaataccaataataaaaatcctgtaaggaaaactaggaaactatagtcttatgtgggggagacttttcagcattagaaaactggaagctataaaagaagagatagctgtttgccttttcagatgctgaaactttgtaaatggtaaaagacatttaagtcaattgaagaacaccagattatgagaaaatatgcagtgcagaggaaaaataacatttaattgtgaatttcatatttaggaactcataaataaaaattagccaggccttgtggcacatgcctttagtcccaaccactcaggaggctgaggtaggaggattgcttgagcctgggaggttgaggcttcagtgagccgtgattgtgtcactacgctgcagtcttggtgacagagcaggactttgtttccaaaacaaaacccacaatgagatactatttcacatctgttaggatggcatccgttaaaagataaaacaaaataacaagtgttgacaaagatagggagaaactggaacccttgtacactgtggtgggaatgtcaaatggtgcatctgctatggaaaacrttatggcggtttctcagaaagttaaagaatacaactatcgtatgttctagcagtcatgcttgtgggtatatacccaaaataatcaggaggaggatttacttgcacacccatgttcacagcagccttattcataacagccaaaaggtggaaggaaccaaaggctccatcagcaggtgaatggataaacaatgtggtatagacatactctgggatgttattctgccttaaaagggaaagaaatcctgtccattgctacatggatgtaccttggaggacatcatgttatatgaaataagctggtcacaaaaggacaaatacagttgatcctttgtatccgtgggctctgcatccatgagcttaaccaaccactgatggaaaatatttggaaaaaaaattttttttaaatgacagtacaataataaaaaaatatgaattaagcccgacgtggtgacgcacacctgtaatcccagctacttgggtggctgagatgggaggatggcttgagcccaggaatttgagatcagcctgggcaacatagcaagaccccttctgaaaaaacaaaaaaaaaaaacaaattaaaaaaatataatctaattacttacatccgtagcagttacattgtattaggtattaggtaatctagggatgattgagagtatgcaggaggatgcatgtaggttatatgcaaataaaatgccattttatataagggacttgagcatcctcggaaattagtgttggggagtggtcctggaacaaatcttcgtgggtacggtgggactaccctattgcattccacttacatataattgaaggcatattttttgatgagtaaatattatgtgactatctaaaagaaaagttactgtttaaaaacataactgtagggccgggcacagtggctcatacctgtaatcccagcactttgggaagctgaggtgggtggatcacctgaggtcaggagttagaggccagcctggccaatatggtgaaaccctgtccctactaaaaatacaaaaattagctgggcatggtggtaggcgcctgtaatcccagctactcgggaggctgaggcaggagaatcacttgaacccaggaggcggaggtttcagtgagtcgagatcgcaccactgcactctaccctgggcaacaagagtgaaactccgtctcaaaaacaaaaacaacaacaacagccacaacaaatgtaactgtaatggtataccttctccagaaaagcataccaattctttaaatattaccagagatccacatccagtcagggttctgatttccctcaatgctctcttactattgtgttttgttttgttttgagacagggtctcgctctgctgcccagcctggatggtgtccagtagtgcgatcatgattcactgcagccatgaccactaggctcaggcggtcctctcacctcagcctcctgagtaactgggagtataggcgtgccccaccacacccagctaatttttgtattttttgtagagtgggggtttcaccatcttgcccaagcaggtcttgaatttctgattctgatctcaagcgacctacccgcctttgcggccgccattgtacccagctcttttgttttttaaaaaaatatgggctgagatggggggatcacttgaggccaggtgttcaagaccagtctggtccaacatagagcatatctgtacaaaaaatagaaaatcatagccaagagtggtggcacaagcctgtagtcccagctactctgcagaccaaggtgggaggatctctggagcccaggagtttgaggctgcagtgacccatgataaacggcactgtaatccatcctgggcaacagagctaaaccctgtctcaaaaaaaaaaaaaaaaaatagtgggctgggcacggtggctcacacctgtaatcccagcactttggaaggccgaggtgggcagatcacctgaggtcaggagtttgagaccagcctggccaaatggtgaaacctcgtctctactaaaaatacaaaaattagctgggcatggtggcaggggcctgtaatcccagctactcgagaagctgaggtgggagaattgcttgaacctgggagacagagtttgcagtgagccgagatcatgccattacactccagcctgggccacagagcgagactctgtctcagaaaaaaagtgtggtaaaaagcacatcataaaatttaccttcttaacctttgttttgttttttgtttgtttgtttgtttgagacggagtctcgctctgttgcccagcctggagtgcagtggcgccatcttggctcactgcaacctctgcctcccaggttccagcagttctcccacctcagcctcccgagtagctgggattacaggcgtgtgccaccacgcctggctaatttttgtatttttagtagagatggggttttaccatgttggccaggctgatctcgaactcctgacctcaggtgatctgcctgcctcagcctcccaaagtgctgggattacaggcatgaaccactgcgcctggcctttttttttttttttttttttttgaggtagagtctcgctttttcgcccaggttggagtgcagtggcaccatttcggctcactgcaacctgtgcctcctgggttcaagagatttctcgtaccggttgggcacggtggctcacacctataatcccagcactttgggaggccgaggtgggcggatcatgaggtcaggagatcgagactatcctggccaacgcggtgaaaccctgtctctactaaaaatacaaaaattagccgggcatggtggcactctcctataatcccagctactcgggaggctgagggaggagaatcgcttgaacccaggagtcagaggttgcagtgagccaagatcgccactgcactccagcctggcgacagaacgagactccatctcaaaaaaaaaaagagatttctcctgcctcagcctcccaagtagctgggactacaggtgcccaccaccacgcctggctaatttttgtatttttagtagagacagggtttcagtaacattggccaggctggtctcaaactcttgaccttgtgatccgcccatcttggcctcctaaaatgttgggattataggtgtgagccaccacgcttggcccctttttttttttttaatttttatttaatttatttatttatatttctgagacagagtctcactctgtcacccactggagtgcagtggcatgatcactacttaccttgacctccccaaggctcaggtgatcctcccactttaaccccttaagtagcttggactccagtgccatcatgcccagctaatttttctttttcttttttttttttgagacagagtatcgctctgttgcccaggctagagtatagtggtgtgaccttggctcactgcaacctctgccttccgggttcaagcgattctcctgcctcagcctcctgagtagctgggattacaggtgcgcacaaccatgccgggctaattattgtatttttacaatgtagagatgaagtttcaccatgtcagtcaaacctgtcttgaactcctgaccgcatgatcctcctgcctcgacttcccaaagtgctgggattacaggtgtgagccactgcgcccggcccccagctaatttttctgttttttttgtagagatgaggttttaccatgtttcccaggctggtctctaactccagggctcaagtgatctgcctgactcggcctcccaaagttctaggataacagatgtgagccactgtgctggcccatgttaaccatttttaagtgtacagttcagtagtgttaagtgaacttacactaagaaacatatttgtaagacctctttgcatcttagggaactgaaaccctgtacccattaagcaacttcgctttgttccctcccctacctcctggtaactgctgttctgttttctgtgtaggttgactactgtagatacttcatataaatggaatcatacaatatgtatgtctttgtgactggcttatttcgtttaatgtaatgtccacagatttatccacattgtarcatgtgacaggatttccatcccctttaaggctgaataatattccattatatgtatatatcacaatttttttttttctttttgagacaagtcttgctctgtttcttgcccacgctggagtgcagtggcacgatcttggctcactgcaacctcagcctcccgagtacctgggactacaggcacacgccaccacgcccggctaatttttgtatttttattagagtcggggttttaccatattggtcaggctggtcttgaactcctgacttcgtgatctgcctggctcggcctcccaaagagctgggattacaggcttgaccaccgcgcccggccacaatttttttttttaaatctattcttctgctgatggacttttgggttgctttcaccccttggttattgtgcatagtacttttgtgaacataggtgcacaaatcttttgagattctattttcaattcttgcaggtgttactcggcagtgtaatctattggatcatatggtagtttttgtttttgtttttgtttttgttttaagacagtattactcttgttgcccaggctggagtgcaatgatgcaatctcggctcactgcaacctctgcctcctgggttcaagcgattctcctgcctcagcttcctgagtagctgggattacaggcacctgccaccacacctggctaatttttgtatttctattagagacggggtttcaccatgttggccaggttggtctcaaactcctgacctcaggtgatccacccgcctcggcctcccaaagtgctgggattacaggtttgagccactgcatccagccagtttttagtttttttaggaaatgccatgatcttttccatagcagatgcaccatttgacactaccactaatagtacatgaggattctgtattagtctgttctcatgctgctatgaaggaataccccagactgggtaattcataaagaaaagaggattacggctgggcacggtggctcacgcctgtaatcccaccactttgggtggccaaggtgggcagatcacgaggtcaggagatcaagaacatcctggccaacatggtgaaaccccagctctcctaaaaatacaaaaattagctgggtgtggtggcgtgtgcctgtattcccagccacttaggaggctgaggcaagagaatcgcttaaacgtgggaggcagaggttgcagtgagtcgagattgtgctatggcactccagcctgtcgagagagcgagactccgtctcaaagaagaaaaaaaagaggtttaattgactcagagttctgcatgaccggggaggcctcaggaaacttaaaatcatggaagaaggcatttcttcacagattggcaggagagagaatgagtgccagcagaagaaatgccagacgctaataaaaccatcagatcttgtgagaactcactcgtatcatgagaacagcatgggggaaaccatcctggtgattcagttacctccacctggtactgcctttgacatgtgggaattacaattcaaggtgagatttgggtggggaaacagagccaaacggtatcattctgcccctggtacccccgccaaatctcatgtcttcacatttcaaaacacaatcatgcccttccaacagccccacaaagtcttaattcatttctgcattaacccataagtcccagtccaaagctcatctgtgacaaggtattacttcgttctcatgctgctgtgaagaaatacccaagactgggtaatttataaaggacrgaggtttttttttttttttgagatggagtctcgctctgtcgcccgggctggagtgcagtggtgcaatctgggctcactgcaagctccgcctcctgggttcacgccattctcctgcctcagcctccagtagctgggactacaggcaccccccaccatgcccggctaattttttgtgtttttagtaaagacggggtttcaccgtgttagccaggatggtctcgatctcctggcctcgtgatccacttgccttggcctcccaaagtgctgggattacaggcgtgaaccaccgygcccggccaggacaggtttttttgtttttgttttttgtttttttttcttttgagacagagtctcgctctgtcacccaggctggagtgcagtggggcgatctcagctcactgcaacctctgcctcctgggttcaagcgattctcctgcctcagcctcccaagtagctgggattacaggtgcctgccaccacgcctggctaatttttgtatttttagtagagacagggtttcactgtgttggccaacctggtctcgaactcctgacgtcaggtgttccgtgcccccttggcctcccaaagtgttgggattacaggcgtgagccaccgtgcccagccgtaaacctcttttctttataaattacccagtctagggtattccttcatagcagcatgagaacagactaatacagaaccctcatgtactatggccaggaaagaggtttaattgactcatagttctgcatggctgaggaagccttaggaaacttacagtcagggtggaaggtgaaggggaagcaggtaccacctttacaaggtggcaggaaggagaagtgccaggcaaaggcggaaaagccccttgtaaaatcatcagatctcatgataactcactatcaagaaagcagcatgggggtagccacccccatgattcaaattaccccccaccaggtccttcccatgacatgtggggattatgggaactacaattcaagatgagatttgggtggggacacagaactagatgatatcatatatcatctagtcaagacatttgtcttttttattgggtatttgattacgattgtttgattcctaattcaagtaaggttcacactttacactgggtgatagaaacctgtaaattaagagacctcaaacaaagacaaaaacaaaaaattaagggtcaggcacagtggctcaggcctgtaatcacagcactttgggaggctgaggtggtaggatcacttgagcccaggagttgaagaccagcctgggtaatataatgagactccatctctacaaaaaaaaaatgttttgtttttttttgacttggagtctctggtgctgaggcgtgagtgcagtggcatgatcttggctcactgcagcctccgcctcctgagttcaagcagttcttctgcctcagcctcccaagtagctgggattacaggcacccaccaccacgcccggctaatatatatatatatatatatatatatatatatwtttttttttttttttttttttttttttttttttttttgagatggagttttgctgttgttgcccaggctggagtacggtgtcctgatctcggctcaccacaacatctgtctcctgggttcaagcaattctcctgcctcagcttcccaagtagctgggattacaggcatgcgccaccacgcccagctaatttttgtatttttagtagagacagggtttctccaagttggtcaggctggtcttgaactcccgacctcaggtgatccgcctgcctcggcctcccagagtgcctggtttacaggtgtgagccaccgagcccagcctaatttttgtatttttagtagaggcagggtttcaccttgttggccaggctggtctcgaactccagtggtctaaatcctgacctcaggtgatccacccaccttggcctcccgaagcgctgggattacaggcgtgagtcaccctacctggcctacaaaaaaaaattttaagatttaaaaaataaaacacaagagacctcttttttccttgcaatttgttttttgaataaagggtcgtttgtcctggcaaagtttcccacaatctggattttgcgtattgcatcctaagaatggtttttactcacagccgttctgacaccaaatgtgtggggtttttccaccactcgacgaccagttctccagttctctggacaccaactgggtatcctacaattcaattgaattctgaccgtaactacccagaattactgcagactccacaggttaaggactcagtcccataagacagtgcccacttgacacaccagttataagttccaarttgcctcgtgtacttctgaccaaccagctgtaaactggggtttgccatgaccaccttttcaggtttaataatttgctagaatgattcaaaactcaggaaagtgctttatttactgttacttgtttattataaaagacataacttcaggaacagccaaatagctgtgtagggctaggtatgggggtggggcctggagcctccgtaccctctctgggtgtgccaccctcccgacaccttgatgtgttcaccaccctagaaactccaaaccccattgtttaggggggtttttgttttgagacaggttctcactctcacgcaggttktagtgcagcggygcaatctcggctcactgtaaccttcagttcacagcaacctccggctcccaggctcaagcagtccttccatcttagcctcccgagtagctgggactgcaggcatatgccaccgtgtctggctaatattttcgtatttttggtatagacggggtctcaccaygttgcccaggctggtcttaacctcctgagctcaagcgatctgcccgcctcggcctttccaaagtgctgggattaccggtatgagccactgtacctggtaaacttaaattatttgcacagatgtagttcctcagtgcactagcattttatttatttatttttatttctatttatttgtttgtttttttgagacagagtcttgctctgtcacccaggctggggtgcagtgatgtgatcatggctcactggagtcttgacctcccaggctcaagcaatccccctgcctcagtctctcragtagctggaactacaggtaccactacactcagctaatttttgtattttttatagagacagggtcttcctatgttgcccaggctggtttcaaactcctgggctcaagtgatctgtctgcctctgcttcccaaagtgctgggattacagatgggagcccccgtgcccgacctggattagcatttgaataacagctatttcataaaattcttctgccttctgaaaagtatttgagaaggctggcatggtggcacatgcctgtactgtcctgggcctcttctgggggagagtgacaggcttggatttagagcaggcccagccctccccaccctggttggctgtggttcccaaagatgtgtccagtgaccgaagcttgagtcggtgacagcctctgggtaagcttccacaaccctggggttatctgtctgaggctgggcctaggtcaggctgatgggaggatgggtcagaggctgctgtgattggccttgactctgcctggtggtttagctctgcccttgcttaacctccaggagctaggaaggaagtacaaatgggatgtgacatgattcagtggagctgggagaggggagggccctgctcccacctccctttggccactggttggcaaatgcctttagttcaaggtctctctgattagggacttaggaccaaggccttgtggtggaacagcctctgctggtgtaattatgacctattgtttctactgacagcagaatggcctcccctaccagtttaatttgtggtttagggggtacgtttggtgttctttaaccttgtagagtgtggagctactgtggtgtggcatgggacagggggtttgggcatagcaggagaatttggcgtcaaatgggtgagaatccacagggcatttagcagaaccccaggtctgggggcccgtgggtgacttctgtgaccttgagcccctgcagagctttccctgcagttctgccttagagatgcttgaaagagggtttattgaccactgatcacatggcaagtgccctgcaaggcctctaggggtatgtgcgtatgtgtgcacatgcacactgtgtatgggttggcattgagttgagtgtcctaagggtatgttcctggccagaggtgaaactttgacacttgactggtcatggaggatgaattggtttgccaggtgacctgagaatggggatgagacattctaggcaaagaacaacacatgccaagattgcttttatttattttgagacagggtctccctctgttacccaggctggtggcgcgatctctgctcactgcaacctctgcctcccgggttcaagtgattcccccacctcagcctcccaggtagctgggactactggcgtgtgccaccacaccgggctcatttttggatttttagtagagacagggttttaccatgttggccagggtggtcaagaactcctgacctcaggtgatctgcccgcctcagcctcaagtgatccacctgcctcatcttcccaaagtgctgggattacgggcatgagccaccacacctggccaagactgtttttagagataataacttagaccaggcataatggcttacacttgtaatcccagcactttgggaagatgaggcaggtggatcacttgacccaggagtttgagaccagcctgggcaacatggcaaaaccttgtctctayaaaaaaatacaaaaattagccaggcatggtggcatgtacttatagtcccagccactggggaggctgaagtgggaggatcaccttagcccagggaggtcgaatgcattccagcctgggtgagtgagaccatgcctcaaaaataataataataataacaagatagaggcacagagacatgacctcagggtcacgcaggtaagagtagaccaggaactcaaatctaggtgtgattttgaagtatgcatggaaattggccaggagggcttgttaaaaatacagattgcctggccataccccagaatttctgatccagtagatctggagtggggcttaagatttagcgtttctaacaggttccaggtgatgctgatgctgcaggtcaggggaaccctgtgatgtggacctcactaggctcttgatttgtgctgtcatactcaatcctcatgacggataaggaaacaggcttagaaagagtcaaagttgttcacttgtctaaggccaggagccaaataatgacaggtggcaatagtatgggtggagggttgtccttgggtagcagggaggctggctagcacatcctggagtggaaacctcctgggaaggtgtagtggagaaaaaggatttgaagttgatagcttgcttgctggagagagggtgaacaggctcttccttcaagaaagctccctggctttgacctggcgcggtagctcatacctataatyccagcactttgaccgggcacggtggctcacacctataatcccagcactttgggaggctgaggcaggcggatcactggaggtcaggagttcgagaccagcctgaccaacatggagaaaccccatctctactaaaaatacaaaattagccaggcgtggtggcacatgcctataatcccagctactcgggaggctaaggaaggagaatcacttgaacccgggaggcggagcttgcagtgagccaagatcacgccactgcactccagcctgggcaacaagagtgaaactccatctcaaaaaaaaaaattaaaaaaaaaagctccctggctttctgctaacgtgtcctttttgggtgtggtgtcaagtcttgcatagctggactgtggtcttggagacaggatgcactaagagtaagagtgattagtcagaggagtgggcctgagaactcaggaaaggcttgtgagggactgaggcttgagtttttactttaaacagcgccactttttttgttttggtttttttgagacagagtctcgctttgtcacccatgctggagtgcagtggcctgatctcagctcactgcaacctccacctccctagttcaagcaattcccctgcctcagcctcctgagtagctgggattacaggcgcacgccaccgcgcctggctaatttttttgtattgttagtagagacggggtttcaccatgttggccagattagtctccaattcctttatttattattattatttttttttgagatggagtcttgctctgtcaccaggctggagtgcagtggcacgatctctgctcactgcaacctctgcctcccaggttcaagcgattctcccacctcagcttctcgagtagctgggattacaggcccccgccaccatgcccagctttttttttttttttttttttttttgtatttttggtagagacagggtttcaccatgttggccaggatggtcttgaccttgtgatccaccctcctcagcctcccaaagtgctgggattacaggtgtgagccagcgcgcccggccaagcatcactttttaaaacagccagtttattgagacaggtgctttgcaggtattgtcattacaaccctatgagatagatgtattttcctcattttgcacatgaggaaaccgagtttctgggtgcagtgctttgcccttgcacccagcaggtagagagtggggctggactccaggctgtgggacactgtcccctgctctgatgcctcatggcctttcttccctctccagcttatcacacagactttcagccaccacaatcagctggcacagaagacccggcgggagaagagagcccggcaggaggccgagcrgcgggagaaggcggagcgggcggccagactggccaaggaagccaagtcagagacctcagggccccagatcaaggagctaactgatgaagaggcagagaggctgcagctagagattgaccaggtgaagggtgggcttcccttctccacccctcagatcccccctggcactgagcagtggggtcctgttgccaactgctgtgctctttgccccagaaaaaggatgcagagaatcatgaggcccagctcaagaacggcagccttgactccccagggaagcaggtgagatggactgcagggacttgggatgagccaggagcttggaacttacaggaaatctcctgcctactgctttctctggaatacccttccttatcctatcccctcccctcctggctttgggaatcttccccatactttaagatcacactcagagacattgaaccaaaggatccaggttaaaaaaataaaaacctgccaggcgcagtggctcacacctgtaatcccagcactttgggaggccgaggtgggtaaatcacgaggtctggagttcaagaccaacttggccaagatggtgaaaccccatctctactaaaaatacaaaaattagccaggcatggtggtgggcgccygtaatcccagctactcgggaggctgaggcagagaattgcttgaacccgggaggcggaggttgccatgagccgagatcacgccactgcactccagcctgggcgacagagcaagactccgtcccaaaaaaataaaataaaaaccgactgaccttaacctgtttatggcaagaaaacccaatagccagagagggcagtgcctattacaggtcccatctgaggttggctgggttctgtgggcccagccatatcctttgtcacatggtataatattaatagtctgagctcctctcagactgagatcagaaccaagttttacctggttcccagtggaccaaggcttgggggtctgcccctctgtggagtgggcagggaccaggtctgttttcttttgtggctgtatgcccagtgctagccctgggcttggcccagtgagggttcaatctgtgtcttgtctgtcaagtaagtagctgagtgtccctgattgtaagcaggatactgaggaagatgaggaggaagatgagaaggacaaaggaaaactgaagcccaacctaggcaacggggcagacctgcccaattaccgctggacccagaccctgtcggagctggacgtgagtgtcagggaccagaggtaaagcttagggggccagcctggggtaccagcagcacttagtggcctcttctgactgcctctgccctatgcagctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaaggtatgtgaggcccagcccttctagcctggggtgttgatggaagtagaagggaggatgtgtgcttagtttactcaggagccatgctgggggcattgtgggattatcttaatccccatgacaacactctttaaagtagatctgtctctattttattttcttaaagacaaggtctcactctgttgcccaggctgaagtgcagtaacaccttcttagctcactgcagccttgaacccttgggcccaagcaattctctcgcctcgtcctcctgagtagctaagactacaggtgtacaccaccacgctcggctaatttttgttattaaatttttttgtagagaccggggggtctcactatatttcccaggctggtcttgaactcctggcctcaagtgatcttcacaccttggcctcccaaagtgctgagattacaggcttgagtcaggaaaagagctcgttgatttacccaagctcctacctctgggaaggggtggagtcagaattgaaagtcttagtttctaaagccacttctttttcactaggtttgtacatgcattcaattcatcaaatacttgaacacctgctctgtgcctggtactgttcttgttctaagtgctggaaagagaacagtgaacaaaacataggaaaatatgtgccctcaggaagccttcattctcaacctcactgcctttacagagaggtaggacacagagatcagtaaataaaggtggtctgaaaagggccaagggtctgaggagaacttcccagggcacataagaccctgtmacagcctgtccgactggcactggctgccttcactcactcacccctccatgcctctgcacttgctttgtcgcccaggctggagtgcagtggcgygatctcggctcactgcgagctccgcctcctgggttcatgccattctcctgcttcagcctccagtgtagctgggactacaggcgcccgccaccatgcctgtatttttttttttgtctgttttgttttctattttttagtagagacagggtttcaccgtgttagccaggatggtctcgatctcctgaccttgtgatccgcccacctcggcctcccaaagtgctgggattacaggtgtgagccaccatgcccagccctttccctgccttttaaatttattttttattttttgagacagggtcttgttctcacccaggctggaatgcagtggcgcaatcacggcttactgcagccttgacctcccgggctcaaacgaccctcccacctcagcttcctgagtaactgcgagcgccaccctacctggctaatttttaaatgttttttgtaaagacagggtctcatgttgcccaggctggtctgaaactcctgggctcaagggatcttcctgccttggcttcccaaagtgttgggattacaggtaggmgccactgcacctggcacttccctgcttaaaaactttttctggctgggcgtggtagctcatgcctgtaatcctagcgctttgggaggctgaggtgggcagatcacgaggtcaggagtttgagaccagcctggccaagatggcaaaccccatctctaataaaaatacaaaaaattagctgggcatggtggtgggcgcctgtaatcccagctacttgggagtctgaggcaggagaatcgcttgaacccaggaggtggaggttgcagtgagctgactgcaccactgcacatggtggctcacacctgtaatcccaacactttgggagactgaggcaggcagatcatctgaggtcaggagtttgagaccagcctggcccaatatggtgaagccccgtctctactaaaaatacaaaaattagccaggtgtggtggtgcatgcctataatcccagttactcgggaggctgaggccggagaattgcttgaacccgggaggcagaggttgcagtgagccgagatggtgccacagcactccagcctggacaagaagarcaagactccatctcaaaaaatatatatatttattttcttcccattttaaatctggaatactgctttgtgtcttaagactcagcccgagtgtcactttcaaacttttctccctccaccctggatgaatatctccctttctgctttcttctttcccttatcacactgatttgtaactcttygcctctgtgtctcccctagctgcaggaagggcacagtcttgtacctctggatccagtgtaggcctgcaagggtctcaggtgcaggatgtggatgggagagagtttggttgtgaaagggttaaggggtgattcctggtgcacagagcaggccacctcccaccctctggttgttctcttcacagatcaataagatggagtggtggagccgcttggtgtccagtgaccctgagatcaacaccaagaagattaaccctgagaattccaaggtgagccctggctggttgggggagcttcagcaggaaggtgaggggcctcgttgtttccagagcttcaccgattcctgtcactgcctgccctcagctgtcagacctggacagtgagactcgcagcatggtggaaaaratgatgtatgaccagcgacagaagtccatggggctgccaacttcagacgaacagaagaaacaggagattctgaagaagtgagcaattcagagacggggttgggggaccgtgggtgcctgggggcttagacttcggtgacagcagtgagtggatcactgcgctgcctcaggagctgccctgccccctttccagccatgtttatggctttatggctttggcttgcctactcttgtcatttgctgaggtcatcttgagggcaaggccggctcatggtgcatgataggagggaaggggtaacaggcggtcattgccacctacaggaaaacaatgccagtgttggtgcctcagcttccagcctcgggactcaaatgcgtctcagataccctgggccctgctcctgcccagcctggcttggtgttgctgaggtctaaagagattagacttgacacgggggtgctgggagaagggacagctttagaagagaaggatgagctgtttcatctygcttccgtttctccaggttcatggatcaacatccggagatggatttttccaaggctaaattcaactagcccctgttttttcctccctgaactcttggggctgagctgcaaccacccaactttctttcccactcttctctgggacttgtgggcctcagggcttggggcaggcatgggactggcccaggcacacaggtcccggggcatcaggagaaaggctgggtcttgggaccttgtcctycccagttggcctactgttayacattaaaacgatttgcccagctccttctgtgtcctctcttgcctctggcctttctctggggcacaggcctcttacggctgctgctgggaactgggagtttggcttctagcccagattctgccatgtgacctagggcacatccttgcccctctctgggcctcagtttctcattacttaaagattaaaacaaggcttggccgggtgtgatggttcatgtctgtaatcccagcactttgggaggctgaggggagcagatcacctgatgtcaggagtttgagaccagcttggccaacatggagaaacccagtctctactaaaaatacaaaaattagccgggtgtggtggtgcacacctgtaatcccagctactcgggaggctgaggcaggagaatcgcttgaacccgggtggcggaggttgcagtgagccgagattgcactacttcactccagcatgggtgacagagactccatctcaaaaaaataaataaataaaacaaggcttttagtctatgtatgtttctgagcaaaggttgagtttttctggctacagagaccagaacacatgtcagattctcaaaggggcgcatgacccaaaaaagttttaagaccgctggacttgttgatctgatttttacttcccactgcagcgggtctgccctctagccgtgaatcaagtattcttgaaactagagactattgtgtcccagggcagaagagcagcaagggccaaggtgacactgcctggctcaggggaggggtaccaggaggacagctcaggcctcagatctggtgtgtgtggtacagggaccttaccaggaggacagagtaaagtccagtgaggctccattgtttgtatctcagacctggacctctgcagattctaggccttctcaaagccagctcccagggctgaagaggtgctcccctttgctcagatccagcccacagagctgacccctgccccactttggctagagagtggaggtcagaatgcttgggccacagaggttatagcaagaatgtctaggttgacttgctgtgagtgcttagttctttggctcctaaatttctggaacacagatgttttttttagaatttgagaatagctgggcacagtagctcacgcctgtaatcccagcactttgggaggccaaggcaggcagatcacttgacgtcaggagttcgaaaccagcctggccaacatggagaaactccatttctgccaaaaatataaaaagttagctgggtgttggccgggtgcggtggcccaggcctgtaatcccagcactttgggaggccaaggtgggtggaccacaaggtcaggagatcgagaccatcctggctaacatggtgaaaccctgtctctactaaaaatacaaaaaattagccgggtgtggtggcgggcgcctgtagtcccagctacttgggaggctgaggcaggagaatggtgtgaacccaggaggtggagcttgcagtgagcagatatcgcgccactgcactccagcctgagcaacagagtgagactccgtctccaaaaagaaaagaaaaagctgggtgtggtggcacgtgcctgtaatcacagctacttgggaggctgaggcaggcgaatcacttgaacctgggaggctgaggttgtggcgagccaagatcgtgccactgcactccagcctgggcaatagagcgagactctgtctcggggaaaaaaaaaattcagaatagcttgttaaagatttcagagaggctatgcagtacatagctttgtctgttttccaaacttgctaaacctttttttttttcctgggaatgcaaataatggtttaaaaggctaggtttggaaaatggtgctctagggctgaggcttggttcgtggtgtcactctaccgctctgtactcctgttctgccccgtggtcattttaatcttttggaggccttgacccggatgcgacagcagagcctggagttagaactgaaccctatgttcatagccctgagagatcatcctgtttcccttaggaaactggacaaacaagtacaatttgtctagtagttactttccaaagggtgcctttcggaacaataaaaagggcggtgggggcagcaggtcagatgggagctggagtggggggatcctcaacactttctagcttgtttgttaattaagaatgggctggtgggcctgccccggcctctctgctgaaagaggaccagtagataagcctgtgtgtgaggagcagccaagtaggatccttctgaactcatctgggctctgctacctaatgaagggattctgcatctgccccagcaaggccagagccacagttactaactgcgtgtcccactaagttccttgacctcactgtgagccccacgtttcctctctgtgaaagaataatgtcctttctccaacgttattggagaggccaagaagatactggtgaaaaccacagtgctggccaggcgcggtggctcacgcctctaatcccggcactttgggaggccgaggcgggcggatcacctgaggtcaggagttcgagaccagcctgaccaacatggagaaaccctgtctctactaaaaaatacaaaattatttgtgcgtggtggcgcatgcctgtaatcccaactgctcgggaggctaagttagaagaatcgcttgaacccgagaggcggaggttgcagtgagccaagattgtgccattgcactccagcagcttgggcaacaagagcaaaaactccatctcaaaaaaaaaaaaaaaaaaaaaaaaaccacagtgctctgttactaccacagagagagtggaaggggagcagcaggtccaaggctgggtagggccaacaaatgatcaaggctttggggaaactgtgggctgggcagaagcaggccagcctgcaggcagtggactgggagagcagaggcagttcggacaggcctccctagaagaacctctcaaacaatgtcagaaaccatttatccaacctttctcaggcacagactctgtgcttggttctttatctcctggaactcacagtgaacctgaaatgggggcagcattactcccattttatccttcctactttaactgcagggcactaagccaggctggacacatatcctgtctcctgctctgggcagcagttaagtgaggcagatgggagagaaaggacagccaagaaagcaggcagataccaattacctttgtacttacaaactgtggtcatgttaagatacagaacatcagccaagaaccagaaccaactccttaacataacatagagtgggccctgcccaccccccaatacaatacatttaagataagcttcttttaactgttgaattaccccagggagggagaagtttgcatgattggttagggtggcaatagggggatggagtcagggttcactcccagaaggtaatgcctaactccttactttccatgatcaggccacctgaagaccatgagcaggaaggaaggggccctggcagggatcagaccagctggggatgcaaggagatgtagatcccatggcccagtgaaatgcacatggtccaggaacccagtcagccaaggcaggaggagccagagtgggcactgcttcaggtctaagcctctcccacaggggttcctggtccccctcttcattctgtaggccatgcttctcccagaaagggtgtggcagctgggcctggcaggggttagcagtacacctggagcaagggtgcccccgacgagtctgtgtcggtgccctggaaggatgagtcatggcttgctgggtaccctggtaggaaggagaggagaggaggaaacaggctcaggggaaggagctcatccagatcccatgaccagggagaagcctgctgagaaggagcagagtgggacttgagcctgggtcagtctgatcctggctggatgacccactcagtttattgacctctctgagccctagcctccctttctgtaaaaggataatgattccactcccagggggttgttgtcaagggcaagaagaccgcaacagaaccacacgggtgtctttccagcaccatgctggatggctccccacccactactttcctagtcatctgggcttgaaggttggggtctgatcactttcagcttgcctgttctgggcacctgcacccactttaagccagcttgctagatggagacaggtctgtggctgcttaggtccccgtccctttttgatgtcatcctcatcaccccaaaagaaagctgggagagcagcaggtgaggggcccctagggtagtcccccaccctccacacccctcattaggtcaagaccacacctggagctccataaggcctcagcttccgggcgatggcatctgcagtcgtctcctgggagatctgcactgtcagctctagggagggaacgtgaggcaagcagtggtcattagcacgttctttcaaccctatttcctacttctgttcccagcccgatgagggaggagccactcactcctgggcagggctagaaaaataatgcttaaagacagagacatagacaacgtgtgcatgcgcagagtgatggatgagtgggagttttggttagcccagaacaggtcagaggcccaaattcatgtgggtccctaggtcctgttcaccagaccaggcctagaagctactctggcaggagacagcagaggagaggagccttttgggtaaacttgttgaatgcagagggaaccttgacctttctggggacagcagcgatggccagagagctctcccagggtctgcatgcttctctcagccttgctcggacctcaccaggaagggccagagtgggagctggggagaggggatgcaagagttgacagaaaggaggaggaaaggcagggactggctgaggggtagacccacagtgactaaagaccccattccaaccctcccctggccagagcctcccctactctgcccctcagccccatggggcccccacctaccatcctggctgagacctgagcccaccatggtctcatggccactgtcaggggcagcagcggttggggcagcagcccgagttgaacgaccctccgaggtctgtgggcgagcacggctctttcgggtactaatgcgaatgatgccgcgtaccaggcggccctcagcatcctgctcatccaggtggtagtcctgcgtgatgctgctgataaggtccgagatcttactggtcttctccaggaacacagtgtctgatgtgcacttggccagctcatcgatctggtgtacgctgaacagctctgtcagcttcttgaagatgagcacatcaatttctcggctcgacatggagccactgcccatctccggcaggtccaggtccgactcatggaaagaatagtactcctcggagccacgaggactactggcaaaggtgctgggcaggctgtgtcgcatgggtgggggatcggccagtggctccttgcagcaggagtccgcatcaggggctggggaggtggccctcgggtagggatacacagggatgcctttgagcttaacatcggggtagctgaagctgctgcccatggttgacttgagccgctggccatcccgccggctggggggtgcacgatcagggctggggggcactccattgtgctccttggcccagttggcttcagcagtcccctcagtggagtcctcagtagacaggcaggggctgcatccccgcacacaggctccacagcgctggaggcaatcccggcagcggcggaagcagaaggcagcccggcaccactcccacacccagggtcgccagagcaggcagcaggtgggggactcaagggccggctcagcagagccagagatgaaggtaatgctctctggcccatggtggccagggtccttggggtctggtctacgggtgcggcggcttggtgggggctgaggtggtttatcatatgtctccagacatagctctgttggccgctcccacggtcccaagcgtggaggcccagatgctgggcgggggtgtccagggcggggcatggctcattgcatggtttgtagcagccaggcacctgcgtggggagaggccaggaaggagtcaggatcagaggtgagggacaaactcctgggctgacttgagcagcttcacatttctagtttctgagaggcctgggatgtggatggacccaagtatgcccaaaaacccttgcctgggatgtggatggacccaagtatgcccaaaaacccttatctcttgtggccctccctccacaaagagaaagtctctgtggtctaacccagatttcaaaattccctgtgacttagacctattgggatggctatgaaaggttgaacattggccgggcgtggtggctcacgcctgtaatcccagcactttgggaggccgaggcaggcagatcacctgaggtcaggagttcgagaccaacctgactaacatggtgaaactccgtctctactaaaaatacaaaaaaaattagccaggtatagtggtgggtgcctgtaatcccagctacttgggaggctgaggcaggag

SEQ ID NO: 12490 - DNA, 12960 bp, Homo sapiens
tttgccatggagcctgtgctcctttcagccgaggaagctgtccagaaagcgaggattgtccagggatgcagagtagctgcagtacagccgccccatgccgctctgggaaaaaggcctgtggattcgagtccagcctctgagcagcggctgccagtcctgctctggggactcgtggagggcctgagatccttccaggcagatgatgagatcgaagcccattgcatgagggcaccttttgctcccatgctctgatgggcacacggcggctttcgagggctgcaggccagagcaggcacctgacaaggctggtaacatacgcagccaaggctggattttcttcatagacttcaaccaacagcacatctcagcagatgaagtgctggagccgatatgggaatccagcttccactaagccggacaatacaaagattcgcaccaacgtagaaccacgccacttttctcaggcgggtttttcatttttaaaagtatgattgcttttcataaaacattatgctatttatgttaatgtgtaatagcaatattttcttatttttaagtgaattggcaagtattctgaacatttctgttatgatttagaaaatgataagtatccataggtataacccatacaaacaaaaaagttcttcagtgtcctcaattagttttttttgtttttgttttttgtttttttgtttttttttttttttgagatggagtctcgctctgttgcccaggctggactgcagtggcgcgatcttggctcactacaacccctgccccctgggttcaagaaattctcctgcctcagccttctgagtggctgggattactggcgtgcaccaccacatccagctagtttttgtatttttagtacagatggggcttcaccatgttggccaggctggtctcgagttcctgacctcaagtgatccgcccgccctggcctcccaaagtgctgggattacaggcatgagtctcactctgtcgcccaggctggagggcagtggcacacacagttcactgcaggcttgacctcccctggctcaggtgatcctcccacctcagtctcctgagtagccgggaccacagacacagtctcctgactagttgagaccacaggcgcactccaccacacccagctaatttttgtatgttttgtagagatgaggtctccctgtgttgccaaggctggtatcaaactctgggctcaagtgatcctcccgcctcggcctcccaaagtgctgggattacaggcatgagccactgcgcctggccctcagtgacctttaagagtatgaaggagtcctcagataaaaacatttgagaagcacggaggtggaaatttgtctttggcctgggggcctggagtctaaatactgcattgagtggctgatctgtggttttcgcttaaaatacaggttagatcatttgtttctgtttgcattctgtcctagttgcttctatttattttttctctctttttgaatctgtgaaacattaacagggttccaaacatcagagtgttttgtctaagcttaaaagccctctgggtgattccgatgagcagaggccgggaaggattgagcaagaccatccccgagctccttcctccgctctgtttccagatcccatgactggggacctataaatattttcctgacatggagcaggatcaacttcagcatctgttagcttcatcccaaaggcagggaagcctagagcccctgggagggctctgcaccgcacacaccgccggcctgcagccccagccctgtgcggggtcctggggaggggggccccctttctgtggctcttcctgactccctgcgcgttccaccccagaccctcagcccactctgacctccctccaggagggatggcttgcaaatgccctctggccacagtgcagaccgctaggctgttctgtgcagctttaggccatgccaggaaagagacttaaagccagggccccaaaggccagggatgcctgcgccgggagccaggagcttccccagccacttccagcatgtagactgaagtcaggccacgcacagggctctccaggtcacaccctgcgcaagaaggtgtagcacgctggctctaatttcgagaaggtgaaaacaagagcccctctgcccccacgccctgagctttcccgaaaggcttggggcaaagaactcccctcagtggcacctagggaggcaccaggaaggcgcttgttggaacgggagagaaacggggagagggaggaggacaggggggaggggaggaggggaggggaggaggggaggggatgaggggaggggaggggaagggaggggacagggaggggaggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgagtactgcgtgcccccgggacacccagagagggcccgggcctcctgcactttccccgcggcccagaaccttgtggcacctccagagggacccccaggactggctgcgaccgagctttaagggtctagtcccgggggcagccagtcggccaaggccccgggtccctgcgacggcgaaggcatcccggaggccgcacccagaccggcccggcaagctgcagggactcggactgaaaacctgcccgttacccctggtcgctcgcaggcgcacgggcgatctaaccccgcgccgtccattccgctgatgggggtctcggaagcgccgcaggagagctttgcggagcagggagggggtcgcgggtgctcggggccgtcctcagagcccaaagtgccgcagccctctcggctttccaccccgaggctgccacgacggtgccagcgcgcggctgctcccctctgtgctcccaggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtgagcgcggggccggccgggggcggggtccggggggccggggccaggcgcgctgagccgctgtcgccgcaggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggccgccccttcctggcctcggtttccagcccgtgttccgtgggatggctgagaggagtacatgggaccctgtccccaacagtggtgcagagggcacgctggacgctgggcagtggccccagtgaggccatacgcataccagaaggtgggcttctcggaccccaggccaacctcctcttcttcctccccagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcctagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgatgagcattctcctagctcttccaggcacctgctggacagggcaggctgggaacgctggggccgagtggcagttccctccctactcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgttcgtggtgtgcaactggtctggcgggaagagcccctcgtgggcagagggtccagagaggtgcggtttgccccacatttgggggcactgggccacagtgggcaggggagcacrtggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggmtgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggtgttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatgtccctggctgtccccacacttgttctgggccccgtgcagtgcagggacccgtggtgtgcgctaattggggacacacattcagaaggcgcctggtgctgccgtcagggccatgaggcacgtgctctgtgtgtgtgtgggaggcaggcctgagacctacagatctccccacaacagacgccacccctggcccatacaggatttcagaagacacagcaaatggcatgtcagatgcatccacaaacccggcaggcacgcgcctgcccacaggacgatcagaagctcagacaaggggcaccttgagatccggacgaggccccagaagccctcactctgccccctcctctgtgggagcagcttgcattgctgctgttcatgggggggccactgaccaccaagaccctcgcagcccatcaggccaccagcagacacctcctgagacctgagctcagaggccccaacctcaaagatgtcctcaggggctcactgtaatctgtcgtggccctttctgcagcaggggtccccaggcctccccaccagtgccactcacctggtggaaccccagggccctctcagtgcctgggcgggagctctgtgtggtttgaggatggagatgcttgggggatggctgcttcttcagtcctctcccagtgactggaaggtgggggctcacttctctcaccgaggcctggtagacgacccttcctcgtaactgtctaaggccctccagccctgatgcttctagaaccagaccccaggcccagctcccaccaccctgcacgccatccccgcccaccatccttgaaaacaatgaactaagcccaagctcacgggcgcatgagctctgaggtgacgtggagatctgaaaaacccctggcttaaagttttcttaaggttcctgggactgacaatgccaggaggcccctgaaagaatggccgtaaatcctgtgtagagatcacactgtgtacttggaactcaagaggatccccaggaacatgaacccacaatcagaacccataaaacgcacagaacaccagccttgatgctcctgagtcagagcacatggcaaactccacggtcagagccaccgggccgctggggctggcatgaccaggagaagatgctgaccgagttaacctcgccaggagctctaaactcaaagacaccagagcagcacaatggggtggtgcattgaagcctcgacagacggacacaacactccagtcaaagggcagagactgcaagagcagactcacagaaccatgcgctactgtggagcctgtgaagtcctgtaggatcactgaaaggctggggaaggggttgtggtgcagactcctgcagacacctggatccacctgccctccctcctggagcatggagctgggggtccctggggtaggacaggcgtcactttggggccagaacatttactgcccaggtgagaggctattgtgctttcctggcctcagggaccccagggcatgtgttgacgtgggtgccatcactgaagtctctggggccccagggcatgtgttgatgtgggtgccatcacagaagtctccagggccccagggcatgtgttgacgtgggtgccatcacagaagtctctggggccccagggcatgtgttgacgtgggtgccatcacagaagtctctggggcccccacgccactaggacggccactgttgtgctgaggcattgagatttgaaggagaccaatggggaacgccatccggtaatggaatgctgtgtgaggaatcccacaggggccgcctggccggagggtggatcagacaggacctatgtggctgccctctcctgaatgaggtggggagcacgggaaggcgcagagtgcagaaacagcactgcatcagtggccgccatcttgacagcagtgagtagtgggtatagacaggaaaatggagaggagaagcccctgcaatagtcccaaaagagagaggtttgggcctcagagacacccgtggacatgggaagaaatggatgagtctgggtttgttttgatgaaaacgcaacgtgaatacttacagacctgcgtttaacatgcctcccagagatacccaagcagttgaccccatcccagtttcaggaaggccttgtcccaactgggtcagcatggggagccaggggggcagtgagcaagtgagggcaagttcacacctgagggacccattcgtggtctgtagccccctgcacactgtgctgccacaggtggacggggggcacctgggccagaaggaggggctccacaactacactgagactgcatgcccctcatattagtgggatgtggatacgctgggctccagggtgctgctgggcctacagggtgagggttggtccagcccactgtgctgagaagtggtcggcagtccacagtgtccgagccataggaggataatcatggaatggcccactgtgctcagcaacaacacacaggccatggggactggggctgaggggtctgtggcactgggggaggaagacaaagggtagaacatggagaagcgatgggcagggagttcctggcaaagatggtaggctgaggaactgagcactgacacctaactccactcccaccatactccattggagctgtagaagagggtgtgtggatggcacaatccagacgcctaccttggcactctcaggggacaccctccacccacagaatggcgaaacgggatggatacagctctgagacactgcccctttcataagatgcagggaggactccactttctacccccacttctaaaaataagtaaacacacacattgaggctggagcaaggaggtggtgtcaggccaaagaaacaagctcatgagcagctgggagagacagggctcctgagggctgctgtgagcttggctagcagcagagtgaaaaggtgaacccagcaccccacatggagagggaccctcgaggccagcaatgccctgtgatataggaaaggacaggagcaattctctcctcaggagctttcccagtccctagtgtgagccccaacaatcaaaatcaggcaacgagcacaacacaaagattaaataaacaagaaaacaagtcgctataattgaaagccagaaaaaaaaaaccaacagattcagacacccaagatctcagataattaacttgtcagaaatgtaatataaaacaaatagaacaaaaatgaccaaccaacaagggaaattagaaacaaacagatacatttggaaaggaaaaattataaaatgaggaagcctgagtgagttggagagctaattagcatagctgaacaaagaattagtgaactggaagatctagctgaagatatcaggcagaatgcagcacagagagacaggaaatgggaaatttcacaaagatatggaagacaagatggaaagttctaaaatgttttaaatcagagactctaaaggagataatagggagagtggagaagagataatatttaaagagaaaatagtgcaaatttacagcactggttaaaattagaagctgtctccagaaacagaaagcataatgtattccaaagaggagaagtgaaagcagtccacgcccacacacagtatattgaaactggtgaacactaaacacaaagaacgaaccttcaggctgggcgcggtggctcacgcctgtaatcccagcactttgggaggccgaggcaggcggatcacgaggtcaggagatcgagaccatcctggctaacacgacgaaaccctgtctctactaaaaatacaaaaaaaattagctgggcgcggtggcgggcacctgtagtcccagctacttgggaggctgaggcaggagaatggcatgaaccccagaggcagagcttgcagtgagccaagattgcgccattgcactccagcctgggagacagtgagactccatctcaaaaaaaaaaaaacaaaaaacaaaaaaaaaaaacaagaaaaaaccttcaaaggacccagaggaatgtacagattgcttatgaaggaacatctattgaatgacagctacttcctaacagcccaaagggagtcagaaggcagtcagataataacttttgaaatgttgagagaaattaactgtcaacccacagctgggaactcagcaacaccttttaagaatgagagcaaaatgcagacattttcagattaacagaaactgaagaatcttaataccaagataattaccctgaaaaacttctaaaggatgttgttcagggtggaggaaaattatcccaaaaggatggtctgagatttgaggaatggtaatacaaattattttaaatctctccaataacaaaagtataaattccccaaagatggagaaaaaaataacagcaaaattagagaagctgaaaagcagcggtaaagtgagagctgatcagcagggccgaggaaaacaaatcctaagctggaagttcaggttcacaaattcaaataactggccggccacggtggctcacacctgtaatcccagcactttgggaggctgagatgggtggatcacttgaggtcaggagtttgagaccagcctggccaacatggtgaaaccccatctgtactaaaaatacaaaattagccgggagtggtggcagatgcctgtaatcccagctactcaggaggctgaggcaggagaattgcttgaacccaggaagcagaggttgcagtgagccgagattgcaccattgcact

SEQ ID NO: 12491 - DNA, 32086 bp, Homo sapiens
tctctaggatgcccccacagaccacaaagcagtcaaagcggttgaagaaggaagacacataggcagaggggcccagaccgtacaatttgagaagcatctccaccgtgaacagacagagcaacactttgttggcatactctgtggggagagaggcagggatgatcgggctggccagtttctgtggtgacatgtggggaggtaactagggaccatggggtgacccacggtagctggtatcaggccaggtgctggctgagggaaggcttagggctagggattggggtgagtttgtaggtcagagtaggtgaagttttgaggggcttggagatggggatgaggggcagagtcggggtgggggccagagtcagtgtctatgagtccagaagacccaaattcacaagtagagttagagtctagggtttcttcgggactggggctggtttgtgggttatgggttagaaatgtgctcggtattcaggctggggctgagattataatgaataatagtaagagctgacacttataaagtgttagctatatggtgggccatacaatgtcctaagcacttttcactttacatcatttactcctcttcgctgcttcatgaagtggatactactatctatcatctccattttgtagatgtggagaacttttccagacagtgtgatgataagagcctggattctggagccaggctgcctgggttctaattctggctctgccactcgctagctgggtcccgagattagtcgcttaacccctcagtgccttgatgctcagtgttctgtgccttagtatttaattcgcataaggttgtggtgaagaaattgtcagtacacataaagaaaggtgctgagaaaggagcttgaggcacacagcaagtgctacctgtgtaagctacaaggtgggatgggacaggctaagggctctggatttatttgggtaggggggaaggcagtgtcttgggggctgaggcgccctagaggttttggatttaagcttctggggtagaaggaataggaggctgggggagacgactagcaggctgggggtgtaccctggatctgggtgagccacacaggctgcccgtggtgctcagaggcgatggtcaacgtgttgaggaagacgagcaacagcacagcccagtagcaggcattggacttcactgcccgacggcagcgtgcccgaaggacccggttggctcggcggaggcggcggctgggggaaggggagcccacaggctgagatcacctacctaagcctgccctggggggctcaggtgggggatccaaaggtcatgagggcttggaggtggggggtttcaaagttatggagtcaaggatttgcacaactttcccaactcaccagactctggttttcatgatcttgtttctgaaaaagaagggggatgggaggtgtgtgtcgtaaagggcagaaggggtgtcagtgactggggccagaggtcaaggactgagatcgaggcttgaggctaaagaaaggacttgagtcagggtttggactggcttctgggctgggtcaggggctgggggccctcacaggcagcgtgtacagctggccagagccccctcctcctcatcctcatcgccttgggtctctgtcatggaaccggtgtcactggctgggaggctggctgtaggcaaggtggggatagtggtcaggacctgaagaccccgaggtccaatctttggctttcacctctgcctacccacccccaccccagcctggctggacccccaccatggctgctggtggagtgtgtggagcgagtagaatgactgaaccagcgcagacgtccacgcctcctattggtcagctcggccagctgtggccctgcagggagagaaaggacaattagggaggacatactgggggcagggttagggccatgtctagggtaggggtgtcatttggagtctttatagctgaggctggtcttgattctgcattttgagccataacttgggggctggggctagagttgttgcagatcaggcctgggtgggtctcaggagggcagaccacatctaaggcatgcagggaatgggccagattggagttgcctacgatggcccgcccggccctcttcagccatagaaccaaggttgtcatcggcggaggggtcctccatgtccagctcttcggcttgagtgatccagtccaggtagccccgcaggtcttcctccatctgctgcttctcccgctgcttctggaagtccccgcgagctttcgctttctctctctccttggagaactccctgagggaggaggatagagggctagggggaggagccaatctgaacaccttgctttcatcactccagccacactagcctcctagctactctttgaatatgccaagcacattctagcctcagggcctttgcactgaccattctctttgcttggaatgcttttccctcagataaccacatggtgcacccacctcatctctttttttttcttttccccagatacagggtctcactctatcactcagggtggagtgcagtggtgtgatcatagctcaccgcagcctcgacctcctgggctcaagcgatccttccacctcagcttcctgagtagctaggactacaggtgtgcgccaccatgcccagctatttttgttcattttttgtaaagatgaagtctcactatgttgcccaggctggtctcgaactcctgacctcaagccatcctcctgccttggcctcccatagtgctgggattacaggcatgagccactgcacctggcctctttcacatttttactcaaataacaccttgtcaagacagcctttcctgacatccctatttataatcacaagatctctccattcttatcttttatctttcctttctttccacagtacatattccatataaaacactatatatatgtgtgtgccaatatataaatgcacacacttattttattgcatatgttgctactttctgtctctccccatcagaatgtaaaaccaggaaggcagagatttttgtcttttgttccactcctaaaatggtgcctcacatacaatagatgctcatgattgaatgaaggagtatttcagatgggttttgaaggatgtctaggagtttgccaggcacaaagaagtgggcagtggctgaggggtgggaagcagggagtgtctaggtccctcacccactcaggacgccaagcacaaggttgaggacgaagaaggacccaaagatgacaaggctcacaaagtacacccagggcagttcataccccatggcatcttgcatctggggagagaaaaggcatgcatccctcagggtaggcagacactcctgcgtgagtgtcagggaggaaaggcaggtgcagcctttgagctctgtgcccacagtccacctcacccagtagagcacatcggtccagccttccatggtgacacactggaagactgtcagcatggcgaagaagaagttgtcaaagttggtgatgcctccattgggccctggccagcgcccgcggcactcagtctggttcagcgtgcacgcacgccctgatcccgaagacgcacagggcgatgggtcctcctccgcttccatgtctgcaggaagactggagcttggggcttcgaagcaggcccactctcagtcgctgccaccctgaagccccgcccacttaggaagctcgacttgggtcctagatttttctctttctctctttctttctttctttttttgagacggggtctccctctgtcgcccaggctggagtgcagtggcacgatctcggctcaccacaacttccgcctcccgggttcaagcaattctcctgcctcagcctcctgagtagctgggattaccggcgtgtgccacaacgcccggctaattttttttgtatttttagtagagacgggggtttcaccatattggtcaggttggtctcgaactcctgaccttgtgatccgcccgcctcggcctcccaaagtgctgggattacaggcgtgagccaccgtgcccggccagtcctagatttttctaaggcaacacttagctccacttctagggcagaaccctgcgagctccgtattctgaaccactgggaagctagggatcccaccaaccgggatttaaatcctggcgtggagtcttgtaaataacaatgaggcaagagcctgggggcggagtcttgtgaatttggacgcgtctcttgaaaataggggaggggcaaggcatgggcgggagtctgggtaaatggtctgagtgtatgagaacagtcgtggagaataaagcttttttttggtttgtttttgttttgtttttgagaccgagtctcactctgtcgcccaggctggagcgcagtgagtggtgcgatccgatctcagctcactgcaacctccatctcccaggctcaagtgattctcatgccgcagcctcccgagtagctgggattacagacatgcaccaccacgcccggctcaactttgtatttttagtagagatggggtttcactatgttggccaggctggtctcgaactcctgacctcaagtgatccatctgcctcggcctcccaaagtgctgggattacaggcgtgaaccacggcgcccagccgaggataaagttttttaaaattgtttttgttattattttttggagactggatctcactattttgcacaggctggtagcaaactcctgggcgtaagtgatcctcccgcctcggcctcccaaatgccgggaatacaggtgtaagccaaggcgcagagtttttgttttgttttgttttgtttttgagacggagtctcgctctgtcgcccaggctggagtgcagtggcgcatctcggctcactgcaagctccgcctcctgggttcacgccattctcctgcctcagcctcaggttcacgccattctcctgcctcagcctcccgagtagctgggactacaggcgcccgccaccatgcccagctaattttttgtatttttttagtagaggcagggtttcaccgtgttagccaggatggtctcgatctcctgacctcgtgatccgcccgcctcggcctcccaaagtgctgggattacaggcgcagagtcttgtcttaagtgcggggcacttgcacttaagtcttaagtgcggggcaggaccttagcctgtgggtacagtctcgtgatggggcggagctattagcgaggtggggttgtagtctgatttagggcagagtcttgaatatatgggtgggacttggttatctggggatggaacctgagcctgggggccgaatcttgtgcatttcagtgggtttccctgagtgcagcattggatctaggaaccgaaggagggggcatgttctgcctaggaggggcgggcagactaaccggatcccaggaagtagcacgtcttgtgcattcgtccaaggaacagctcgagcccaatgatggcataaatgatgatgacgaagagcacgagcagtgcaatgtgcagcagcggcaccagagccttcatgatggaattgagcactatgtgcaggcctgcggggagggagggggaggcagaaataagggcggggtcagctcagccccacccccaccctccacctccgacctcgggggatgtgccactcactcgggaccccagacaccagcctcagtggccgcagcacccgaaacgccctcaatgccttcacatcgaagcctcctggctttcccccggtgtgcggggcgtcgcctggccgtccggggccctgctccagcagaacgctgaacagcctgatgggggagcaccgggcagggaggcggaggtcaggccttgggattcccccctccaccctaaccttctcagaaaagcacaagtccctgtaactagaaatagaaatgggttttaataatattcctgattctggctgccgaatgggggcggtctgaaagagtcgctttcctgagcccagaattcagcgggcctgacggtaggaaggcgactagggtggggtgcctcccgcagacgcgcacccgaccacgacgatgatgaagtcgagtaggttccagccattgcggatgtaggcgctggggtggagcaccagcccgtaggccacgatcttgagcaccgtctccacagtgaaaatcaccaggaatacgtactccacctgctcctgggggtgggaccggggggcgggtcgggaagtcggggagttatttgaaggcgaggtttgacgggggcgtggggagcatagtcaggaccgagggtggggctgagccaggcagggccatccgggtcagagagggggcggggtctggctggaaggagtgagctctactggggctctatttggctgggaactggctggggcggggcgggccttaccaggttgtggttggcagtgttggagtcgtcctcagggaaggggatgtaaactcccagggccacgcagttggcaaagatggtcagcaggatgaggatgtcgaagggcctcaggtggacacagtcaaggaccctggcagagtggcattggaacccccctactcccttgggaacctcccacccagtgctgacccttgacgcccaaggtgacaggtcctggcattctcgacccctgccctgacaaggccttgactttgtccctcctggaaaccttaaccatccccaactcttgctgtgattcagtccttgactcttgaaccctggtgacctttgcctttctgaacctgccccccaacccagttcttgactcttgaccttgatgatctcagccctcctctgttccagccctgacccaattctttactcctggtaccctgatgacccttacccctgggccctgcccctgccttccaggatgcttccactccacgatgctgatgcaggaccgtcgcagaggattggccagggtgaggcrgaagagtgcccgaggtgaccgctgggcactggccactgccactgtcttgtgcttgctgtgctggtttcttcrcttaggggtccctaggcctgatgcyccactgctttcaccttccacagctgggggcccggggcacagcccccattcgggaccagggcctgccccattggctggactgrgctctggggtggtgtctatatggagaaactgtgtcagggagggacagggtattggggcaattgtggctgcttcctacctgatcctgtccctctgtttgaaggaaggagagaagagcatggaaaattagggagaactgggagtagctgggttaaggactgggaagtaagagtgttcgaattaagattasagtgagagyttataggggagtgaaggtgagattacatttccaagtgaagtasggtttggtgtttaagttgggggtagagtttaaattgccatggggtgggcgaatttaaggttaaatttgagtggtgggttttgggttagggtggggatgggtttagacataggtaggagtggagttttgtctaagggttaggactgggtattttgaattggaattagaattaggatacaggttagggtcgaagttgagttttgagtgggacttgaattttgcattggggttttcagctaaggccactcccagttcccatggtctcgtttcagcctcagagggcggtagattggcctggttaagattcccagctttggatgaaacaagctgcctgagtttaaatcctgactttaccacttggtagctatgtgttgccttgggcaaattatgtaatctctttgagcctcagtttccttatctgtataataaggatgataataacagtacctaaaatatagcggtgttatgaggattaaatgagttcagaatcaaaagaatgcctggcacatagagttattcccattttgcagatgagaaaattgagaagaaaaagttaagtgacttgctgaagtggctgaatggggagtcacactcagtctaactctagagccctcatggcttactaccaccatcaagtatgtcttctctctctttctctcttttgtttttgtttttttttttaaagggtctgtgcactttctggaaagtcagagactgcaatcactaacagtattgacatcccggggttgaggttgaggttaggtcactttaggtctgtatctggggtggggtttagactctaacaggggtttgccttctggctggtagagtttgtgttaggtttcaggtgggcgtttggataggggtcagagccaggattgaggttgggtttcctttgggaactaaggctgtggatgaggctgagaggccatggggggtggtgtctgggtcaggctgagcgttagggctctggtggcagagaggctgtttggggctggctgggatggggaacagggtgatgtggttcttgtcccctagaggctctctgggggtggggtctgggtgggcaatgggtgggtcagaggggctctaccttgctccaagggtctgcagggatggaaggattctctcacctttcccgccttcagattccgacatctttctttcgagattgaagggccatctgcacacaacccccctctcttcccccagctttggagggattaaggccgcagggcggggcaataacagtgttgtatgggagggtggcggtgggggtgcaaatgggacgtttgtgggccagagcctggcaacagatgaaatatttaccaaatatatacctgcagcaaacagtcaaactaaaataagaaaaacgatgtcattttccagtagtatatggaattcgaagtatrtaggaaaaacctaatatatgtgcaatatctctatggaaaaaagatcaaatattatcaattattattatttttagagacagggtcttgctctgtcacccaggctggagtgcagtggcgtgatcatagctcacagtagcgttgaattcctgtgctcaagtgatcctctgacctcagcctctgtagctgggactgcaggtgtgcactaccatgcccaactattttttttttaaattttgggttgcttcgaactttatttgagaacaacagaagataaacctatcaaaagaacacacaggtgggtgcgggggcacggctagtggcggcggccgggggcatccgggctaaggcttttacttggctgcagactggtcggatttcgcagctcctaggcccccaagctgggcccgtgactccaaggtgatctcgttggactgcgtggctagcttgggcatgggggcctccacggtcagtgtgccctcaggggacagggaggaggagaccttggtggggtccacaccggggggcagcgtgtatttccgggtgaagcatcgggagatgtagccatgctcgtcctgccgctcctcgtgcttgctggtgatctccaccatgccatccttggtcttgaccgtcagctcgtcggaggcgaagtagttgatgtccagggatacgcgccagcggtccgctgtgggccgattctccgagaccccgccgctgagctgccggctgagcgcgtagctgtaggcgggcgcggccaccgcggggctctcgaccgcggcgggggcaggggacgcacgtagcggggccagcagctggtgcccaaccactgcgaccagcccgaaggcctggtcaaagaggcgactgtgcgggtaccagtcgcggaaggggtcccagctggggtcccgcaggagcgagaaggggacgcggcgctcggtcatgctggctggctctgctggggacgtctgcttggacaagtgtcaattttttttttttttttaagagatggtgtattgctgtattgcccatgccggtctcaaactcctgacctcaagcgatcctcccgccttggcctccaaaactgctgggattgcaggtgcgcgtcggctgttcaagaaatggttacatagatttcttttgctttatttatttatttagagacggagtctcgctctgttgcccaggctggagtgtaatggcgcaatctcagctcactgccaccttcgcttccccagttcaagtgattctcctgcctaagcctcccgagtagctgggactacaggcatgtgccaccatgcctggctaatttttctcattttagtagagagggggtttcaccatgttggccaggctggtctcgaactcctgacctcaggtgatccacccgactcggcctcccaaagtgctgggattacaggcgtgagccactgcacccagccggttacatagatatttgctgtgtaattattctttggagtgtacaaatgtgtatcatattaaagcatttattgaatgcatggacactagtaactataacttacatagtgctttcttatcttatgtgtcaggcacatagtacaacgtgctttatataaattaattctgttttaatcctaaaaagcaggtactgtcaatagtcccattttacagatgaggagactaagacacagggaagtagtcgctttgtgttaaaattctgcccttaatgtgtacacttttatagcctagaagatgaatgccgccttaaacgaatgagtcaggaagcccytttctgtccggcccctccactccccaccacacgggttgttcctttttcccttggaagagcccactggactgcaggtggaagaactacagttcccagcagctattgcaagctcaacctccgtgcacactcaccccaggcctcacatccggcatgcgccgtgctcgctcrcagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacgtaaggacagagcccccgcccacccccgaagcccacatccgggactctaaagcccaggaccccgtttcccgggaaccttaaaacccgggatcctgacattcagggctccaactccaggatcctaagaccctcacccccttacacacacacacacacacacacacacacacacgcacacacacacacgcacacacacaccgccctccctgacaccgacatcagaggcctcccaaatcctttaaccatgatatttggtacacccaaagctctgggacccagacaccttgagacgttacaaccttgaaacctcaagacccggaaccctgtaatctggggaatcttaacatcagttccctgagaccctgttatctggagaccctaagacacctgtgccctaagaaccagggagcgtaaaaccccaggaccctggcactcggggactccaaaaaatccctggaccagatacttgggatccttcaaactccagttccccaaacacctggggcttaaaaaaacccaggattctttttttttttttccttttccgagatggagtctcgctctgtcgcctaggctggagtgcagtggggtgatctcagctcactgcagcctccgcctcccaggttcaagtgattctcctgcctcagcctcccaagtagctggtattacagccgtgcgccaccttgcccggctaatttttgtatttttagcagagacagggtttcaccatgttggtcaggctggtctccaactcctgacctcaagtgatctgcccgcctccgcctcccaaagtgctgggattacaggtgtgagccaccacgcccagccaaaaaaacccagaattctaaaatctgacatcagcatttggtcaccctgacgcacgaagactcctccgttcagaggccctaaaaacccaggatgccaacatctagggagtctgatttttgtattgcttgaaactaggtggtcttgatattcagggatcttgatacccagggaccctgacatttggaacttctgaaaacagcagcctcctaaaatctagtcttctcaaaactctagcagctcaatatgtatgcaaagaacatactatctgggaaccaagaaacccagagattgtgccacctggaccctttcaccttcccagactcccaaattttgatatttttctaaactgagttctcttccacccaccattctcctactccaagatcttaggacttgaggatttccctagttcctggttttccaaatggaagtcacagtcaccaacatccaggatctgtctgaactgtaggcatcctccctgccccgaccctggtactagtgtttccaaaaggctgcagggctcagcctgatccctgttgcctgactattcctgygatcaagctggtccccttcttcagggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggtgagtggccctcctcytaatgcacacatcctctttcttcctcttttacaaagtaaccaagttcctttgcaacacttgcctttcctctgcaacacttgcctttcctctgcaacacttgcctttcctctgtcatttttcctgcggcttagttttcattagtggttaaggctgctgactgtactgccaaactgcctgagtagtttagatcctagccccaccacttggtaactgtgtgaccctaacccttctgggccccagttttcctatttgtgaaatggagatgataaatgtagtgcttttatgaggagcaaatgagtttatccagtttgcacctgggctgctcctggcttctatgttttaaatttagctgcaaaataccacccccaccccatagtatccatttcctagttccagaaaatactctgtctgggtcatatactcctaaactaatcactctgtgctctgattggcccagtctggatgacatggtcattccttttttttttttttttttgagatggagtctcactttgtcgcccaagctggagtgcagtggtgcgatcttggctcactgcaacctctgcctcccgggttcaagcaattctcctgcctcagcctcccgagtagctgggactacaggcgtgtgccaccacacccaactaattttcatgtttttagtagagacggggtttcaccatgttggccaggatggttttaatctcttgacctcatgatccacctgccttggcctcccaaagtgctgggattacaggagtgagccaccgtgcccagccttttcttttctttttttcttttttttttttttttgatgtgaagtctctctctgtcacccaagctggaatgcagtggcgtgatctcagctcacggctcactgcaacctccgtctcctgggttcaagtgattctcctgcctcagcctcccgagtagctgggactacaggcatgcaccaccatgctcagttaatttttgtatttttagtacagacggggtttcactatgttggctaggctggtcttgaactcctgacctcgtgatctgcccacctcggcctcccaaagtgctgagattacaggcgtgagccactgcgcccggccgacacggtcattcctataggacactgtgattagccactccttcaggatcctgtggagttgggataaggatgattacccaaagaaaggcatgctggttacccaaaagagtgtctgctatattacctctgtgggaaccacatatcctgcctctgctaagagcaattccaacaatgtctctgtgacagaataaataaagtgcttttcttttaaaaaatattttaatttttttagaggtaagtgtcttgctatattgcccaggctggtcttgaactcctggcctcaagagattctcctgcctctgcctcactagtagctaggactataggcacatgccaccctgcccgagaatttttaaatttttcgtagagayggggtctcgcttttgtagagatgttgcccaggctggtcttaagctcctggcctcaagcaatcttccygccttggcctcctgagtagttgggactacaggcgtgcaccactgtgcctggtaaagagccattctgatgaaacactcacccattcccagtatagagctgagtccaggagtccagttcctgtattcaagagctgcaagtaatgccactccccctggctcactcactctgtgactttgggccagtcttttttttttttgaagcccaggctggagtgcagtggcacaatctcggcttactgcaacctcctccgcctcctgggttccagcaattctcctgcctcagcctgccgagtggctgggattacaggtgtctgccactgtgcccggctaatttttttgtatttttagtggagacagggtttcaccatcttggccaggctggtctcgaactcctgaccttgtgatccacccacctcagcctcccaaagtgttgggattacaggtgtgagccaccgcgtctggctctcttaacctttttgaggctaagtttccacatgtgtaaaatgggtataagaattgtagctactgtatagggttgctgtgaggattaaacatgagttaatgtgtgaaaagctggttataataagctttgcataaatgggattactattattggataggtccgatctggaacctgtgaatacatagtgaatggaaacactttgaactgacccaggaagtatatggtggtggagggacgatagagtaactaccgtgaaaactttcatttagatataggggactgggtggctagagttgttaaatttgggccttgcttatgcagtytctgtctcttagcaacaggtctcagagctccatccatcccttcgctctcaggttcacccagctctcaggagttgtcacattgttctctctggggctcttggtggccttatgaggcaggcagtctgtcccctggcccaggactgtatgtattcttaaggttagcacttaataggggggaagttatgtcttctgtttgcagaggagagtacacagcaggaggtgttgaggtgggggctcaggcttcctgcagttctctgttcttccctcagtgctgtctctcttggattttgttcacctgcttttgcttacattgattttagtgggggttagtgactatggcttttccagtggccaggaggtacatgtgggctgggcacgttggctcttgcatgtaatcccagcactttgggagtctgaggtgggaggatcagttgagcccaggagctcgagatcagcctgggcaacatagtgagacccccatctctacaaaaaataaaaaaaaaatagctgggcatggtggcacacgcctgtggtcccagctatgtgggaggctgaggtaggaggattgcttgagcctgggaggtccaggctgcagtgggctgtgattgcgccactgcactctagcttgggaaacagagtgaaaccccatctccaaaaaaaaaaaaaaaaaaaaagactggggacggtggctcctgtaattccagcactttgggaggtggaggcgggcagatctcaccagaggtcaggagtttgagaccagcctggccaacctggcgaaaccctgtctctactaaaaatacaaaaattagcctggtgtggtggtgtgtgcctgtaatcccagctactcaggaggctgaggcaggagaatcgcttgaacccaggaggcggaggttccagtgagtcgagattgcaccactgcactccagcctgagcgacagagcaagactcttgtttccaaaaaaataaaaaacaggtacatatggttgtctggcccccagcagccttggtttatcagcagcaggcaaaaggagttctcttaatccagctgtgtgctgtccctgtagcccccccgcaactcagcactgccatgttctggcatcttttcttcatatgccctgctcctggcaacagtttctgcaccttagccacctccatattttggcaccttccccactcctggaatgagtttctatatcagtcacagctctttgattgcatattgtggaaaaaatccaaagtaaaataccttaaaagccagtggttatacttatttgaccttgagcctccaaaataaatatatcttgcattgtgacccagtatactcctaagtatagaataatgatggcttctaagtgtactctgtgccaggccctgtggtaagtaacatggtgttaactcatttaattctcaggacaaccttctgctatatgtactgttggtataccctctttcagatgaagaaagtgaagcacagagggattaagtgatctgcctgaggtcgtatagttggtaagaggcaaagcttgggtttgaatccaggaagtctgctttcagagtctatgcagttccaaagcagtggcaactctggaagaaaaaggctttcctaggccgggtgtggtgattcccacctgtaatcccagcactttgggtggctgaggtgggcagattgcttgagcccaggagtttgagaccagcctggccaacatggtgtagccctgtctacactgaaaatacaaaaattagccgggtgtggtggcatgcacctgtaatcccagctactcgggaggctgcgtgggaggatcacttgagcccaggaggcagaggttccagtgagccaagatcacgctactgcactccagcctgagcgacagagcgagaccctgtctcaaaaaaaaaaaaaaaaaaaggaaaaaggctttctttctctcctggcctgtttcctcagtccccatcagaaccctcatgagtccttttgttctgagctattgtgcttctggtctttttgtcctgtttatttttaggcactctttctataataggtagatttgctctttacctatgatatgggctccaaatattttttcccaacttgtcattaacttttgactttgcttattctattttctttaaatattttctttcttttcatgtattcaaaagtacccatcttttcttttatggcctctggattttgagtcatagaaaggccagagctttaatcttgtttcttgttctctgtagcgttgactatcatcactctgtgactccccccagggcccagaggccttggggagctgggggaggttgggagggtggtggttagtgagaaagtgggagcgttttcagcctaggcccaagtctcccagggcaggaggaccctgcctgcttcctgatagccgcccaccaaccctcaggacctgggctatcccttggagcttggctatcagaacttcctctaccccagtgagcctgacctccgagacctgcttctcttcttggctgagcgtctgcccaccgatgcctctgaggatgcagaccagcctgcaggtactgggtgtctgggrtgtgggcgggggcggtgaggggagaggagggccttctaggggctgtagggctgagagaggtagaggtggtaaaaaggttgatgggtaggrgtggcggtatgtgccttcaggagagctaggcaggaggattaggcatcagagaggggctacagggcagggggcagggggctgaggttgagctgaccccggtggtgcgttggtgcggggaggggcctccctgactcaacccctgtgccctccctctctctcacttcgctctaaccacttgggcctcctgggtgctactcaaacataccccagtacactcccgcctctgcacctttgtatcgttggttacctttcccctaggtaccctcatggttcactcccttacctctttgaggttaacctcctctccgcagccctctcctgatccccacctggctgcagtctggatggtattcaggatcctattcatgatctctctcctctgctagcttgccggctccctgagggcagggacctttatccagtttgttccacgaagtagccctagtgtctagaacagcgacctgtacatagtaggtgctcggtgtttgttgaatgactgaacgtgagaacgcaagctggatagatgtgtatctctggatgggggtcaggagtggaggctggtctcctagggtatgcccttttggatttgcagcattgacatctgattcacttcctccctatcccccataggtgactcagctattctcctccgggccattgggagccaaattcgggaccagctggcactgccttgggtcccgccccaccttcgcactcccaagctgcagcacctccaggtgagacccctgactcccatggatcttctcttgtccccgtctgggtgcccagggttttggccccctacccctggcaaccctcatcccacttcaccctggagattctgagcctgctctcccaccagggctcggccctccagaagcctttccatgccagcaggctggtcgtgccagaattgagttccagaggtggtgagcatgaggctgtggggaggggtgaggaggaaggtgggggggaacctcatagcgttgccatgcggcagggccagctgactctgttcctgcctccagagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggtacagccagatgcctggctccctgctgtctgggctgctgctcactgacactcccgctggtcctctgctctccttccccactttgtccctcccttccattgtttcccctctgtgtgtgcttacctagctccccacctgaaagaacactggagtcagaaaaaaggagaacctgggacaagtcagtatccctcctcagagccttggtttcctgtgctaaaatttggggtagtaatagtgctctcctctcagggcagtagttagactgaataatgtgcttgagattcctggcaactggagcaatccagattggctacctgccttcatcattcattaattcattcattcatttggagtcttgctctgtcacccaggctggagtgcagtggcgtgatctcagcacactgcaacctccatctcccgggttcaagcgattctcctgcctcagcctcccaagtagctgggattacaggcttgcaccaccacacctggctaatttttatatttttagtagagacagggttttgccatgttggctaggctggtctcgaattcctgacctcaggtgatctgcccaccttggcctcccaaagtgttgggattacaggcatgagccaccgcacccggccctaatctttctctgtttctgcacttgtcactgatgttcatttttctggtttctaggtttttgcacaatttctgcctgtccccattattctagttctgtgtttttgctgctcctctttcttacctctctgtctcctcgtttctgtactgaattcctctcttgctctgtctatctatctgttcccccttctcctctgtctacttctttatctgtcccctcttcttctctgtgcacctttttatctgtgtccccttctgctctgtccacctctgtatctctccccttccttgctgtccacctatatatctgtcacccctctgcctctgtttacttcttaatctctctcctcttcctctctgtccacctctgtatctgttgccccttccctctgtccccttatctctcccttcttcctctctgtccacctctgtatttgtccctcctccccttctgtccatctctttatctgtcctctcttcttctttttttttgagacggtgtctcgctctgtcacccaggctggactacaatggcatgatcagggctcaaggcagcctcaaattcccgggctcaagcaatcttcccacctcaggcatctgagtagctgggtctacaggtgcgtgcgcccggctaatttttgtattttttgtagagatggggttttgccatgttgaccaggctggtctcgaactcctgacctgaagcaatccacccaccttggccttccaaagtgctgggattacaggcatgagccaccatgccgagccccctcttcttctctgtcaacctctttgtcccctcttcttctctatccatctctgtatctgtcccctcttcccctctgtccacttatctgtcccctcttcctctgtccacctctgcatctgtcccctccttctctctgtccacctctctgtcacccctctccctctgtccatttctttatctgtccccttttcctctctgtccacttctctttttccctccctccattctgctctcctatttctgttccctcttcctctgtgttcacccaggtatcagtacccctccccttctgtccacctttacatctgtcccctcttcctctctgtccacctctgtatttggcccccctccccttctgtctgcctctttatctgtctcctcttcctctgtgtccacatctctgtctgcccctctttttctccacctctgtgtcggccccctcctggtctgtccacttttttatctgtcctctctttctgtcttcacctctgtgtctttttacatttttatttttttatcattattattattttttgagatggagtctcgctctgtcacccaggctggagtacagtggtacgatctcagctcactgcaacctctgcctcctgggttcaagtgattctcctgcctcagcctcccacatagctaggactacaggcatgcaccaccacgcccagctaatttttgtatttttagtagagacagggtttcaccatgttggccaggatggtctcgatctcttgacctcatgatccatctgcctcggcctcccaaagtgttgtgattacaggcgtgagccaccacgcctggctgtctgtttttgtttttatatctgtagtaattttcaaacataaatgtagagagaatattctagtgaatcctatgtaccattttgccaacttttcttcatcttttctctcccaactttttctttgttgctgtattattttaaagcaaatctcagacatcatgtcatttcagctctaaatacttaggactacatctcttaactcataaggacattcagttttcaaggtaaccactggaccattttcatggctaatgaagttaacaataatatcttgtgggtttttttttgttttgttttgttttgttttttgtttttttttgttttgtttttgagacggagtctctctctgttgcccaggctggagtgcaatggcgtgatgtcgcttcactgcaacctccacttcctgggttcaagccattctcctgcctcagcccccaagtagctggaattacaggagcacactaagttttgtatttttagtagagtcggggttttaccatgttggccaggctggtcttgatctcctgacctcaggtgatctacctaccttggcctttcaaagggctaggattataggcatgagccactgtacccggccaacaatgatatcttaataccatccaatacttgagttcataatcagattttcccattatcttgaaactctgttgtccctctcttgcctctctctctctgcctctttctgtgcttggtacctttgattccctgtctctgccctgtcccccgatatcctgtctatgcttctcttggatttgggggctctaggcccacccccctctcttcccacatccttctccagcatggggatctagtgggtggagagaagtatgtctgtgagcaagaggagacccctgtcctcgaggagatcccaggctggtggagcaggagagtagagcagggcctgccttagtgggaaggctggagggtgggggtgacttgtcwgtatactcttgtcagggggtccttggaggaggcagggccttgggtgctaggtgggcccctacaccttcctgcttcccccgccttttctccccaggaggacacacgggctcagcggcagcggctgcaraagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtgagcagagtggtttggaggggggtgtcccaggcccttgcttgtctactgggcctgacaccccaaccctgactggcctgggcctcccaggtcacgtgggcagctcaggaacaggagctcgagtcccttcgggagcagctggaaggagtgaaccgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggyggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggcygccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctrgtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaagctgaggcatggatcagggctcagggaatgggagtgaggtgagtggcaggggagacacggggtatttttggcaaggcagtgtgtgtggctgtgtgtgtctgcacgggactcaagagacccactggggggctgtgcgtgtgcatatgcgtgagatacacaggtgaattctaacaggccgtgtgtgtgagcgagcacgtgttgggacctcagatcctgagggtactgacgctgcttctgtgtaggcctctgggcacacccctgtgttgacagtgcccctgtgggccctgaggctggctgtgggtgcgtgccttggggtgtgtgggttgtcagggctgtgcttgtgtgtgattgtgtgatgatgcagctttgaggttgtttgagtgtactgaggcaggctctctgtgttttggggtttgtgttgagtgagggacaggattgtgacattttgtgtgtctgtgtgacttttccagccctgaagtaatctgtgcgagcagctgaggcaggctctgtgtggctggttgtgaaggctctgtttggctgcagggctcgactggggggtgtgtctggggcggaggtgggggctggggccaggaccggggcccctctgagcagccttggggcaaaggatatgatgggggagggggtggctgccagcgggggaacaggggccctggcaggcaagacagtggaaacctcacttcttggtccctgtgggcacatccagggcctatcatccctgcccccaccacctctgcctcccaccagtttggcccctgttcgtccatcctcctttccttgatcttgaggtcaggggccaggtgtagggttggaacacctgctgggcctctggctccgtttcttgcggaactccagctcatccacggtccacacagcccccttctcgctctccacccgcacaaagcacttgtgcagactcaggttgtggcggatggcgttctgtggaaggccggggacagggagcaggtgggcgtcaacctctgaggccagcagccaccaccaacaacccacatcccgttcctccccaatgtgcctatgagcccagacccaggcctgcccactttgagctgcgatggcacttgaggccatcccagtcaccgccacctcagaggagctcaccttccaggtggcaggatggtttctgaagaaggcaaacatgcgtgtgaaccagtggtagatctcattgagtgtccgctgcttctctggagcctccaggatggcctggaagttggggggtggggtaaggggcacattccccaaacttggggtttagaggggctatgacctaccccgagccatctgacatgggggcggaattgtaggggcaggtaatcagggacaggactagatgtggggtgaagcatggggtcaaagatggggttagaaaaggggtgaagtgtcgggttgggcagggttagatgggtgtgggtatggttgttctgggattaggtaagggatcaggactgaggttgggagtggggtcttgttcagggctagggctgaagtgaggtgaaaggtctgggatggagttggagttggggttctctgtggaggtgacatttcagggttggggaaggtgaagggtcagaagtggggtcaaggatttggaaggggtaaagggccaggccaacttaagggtcagggaaggggtgggttaagagtcaggctggggtggactcaggtggggggtctaggggtgagggatgggatgacttggctttaggtcagaagccagagatggtttgaattatcgagtatcttacgtgtcagggacatggttaggtggttaggctcagggcaaggatgaggttagttgtggggttcggtgtggagtgaggctgagggtcagggaatttgatcagtttggattcaggaatgggattacagagtcagcgatgatgattgcagtgaggctatcagtcaggatggggctaggtcagggtttcagttcagagacagtcggggaatatctggtatcatgtaggggtgaggttcaggtttggggttaggtgtggcgctaggatgaaggttctgagaaggcattggggaggctgagatgaaggagttgggatggggtgatgaagttaaggatcaaatgggtgttacaaggaaaggttgggaacggtgcccagttgggggtgtattgacatactggggtacgttggggccagggaaggagatggggttgggttggcataaaggctggggaaggagttagagtaagagctggggtacgtttagggcaaggtgcagagatggggttagctttaggctattttatgggtccaggagagggttaggtatggggctgaggtggacatctggaaaggggtaggtttagggtcagaatttggcatgctctggcctggatggtggtttaggtttggatttgcggacaggtttggggtgaagccagcatgaggggtcacatttgaggcacggcttggggatccttggggctggggcttgggaatggaggaacccactctgagggcactcagagggagacaggagtttgggaggcaggtcccccaccccatctttgtcttcctcctccttggggccgagctgccctgcttacccagcggatgagcgtggcgtaggtgaaagggggtcgcatgttgtggaacttgaagtagtccatgttgtggaggaactctgtcagagggtggggatgaatcaagccccatgcaggacctcctagctagctccctgtcccctccccctacaaggtgagtctacaggcctgagatctcaccgtcaacacccgtgtccacgggcacaggtactgtttgctgagcacctgacataagttgtatcatttattctttgcaccacttctgccaaaatagttctccccgaggttgaaaagaagcggagtaacttgcacaccaaaggatgcaagaggttaaatggcagagccaggatgacagtcaaggtctctgatccctgctaagcccacaggccaggcctggtggagagcagtggataggtgagctcgggcgaatccaccccgattttccttggtcaggggaggaaaggaggtgctcctggaattacttagcagggtccctcccttctgatggccgaatatagtagctggagtccagagtgggtgaggcatggccccaatccccaagggagtcagggctaggggcccgacactcgagaccatatggggggctttcaggccacggacatcccgaaaggaagcttttgtgagcggatgcattttcccaaaggctgagtggcggcagctgcagtggtggtggtggtgggaaggggcagcatggagctcctttgcaccctccacccagagcctgtcaggattaggagcttgggggcaccgtgtagtgcaaggaccattcttacctgggaatgtgctgtttccatggctaccccacaggtgcctccggacagcaaacaggctgtcaggggcctcccgggggccagaccaggctgggacgacagggccttggctgccagcagctacgatgcagcaggagcccttgtcggatgatgcctgggtgagggggagaggctggtgacccagaggcttaaacttcccactttttactttctattttatgttttttattttttttgatactgagtcttgctctgtcgcccaggctggagtgcagtggtgcaatctcggctcactgcaacccccacctcccagattcaagcaagtcttctgcctcagcctcccgagtagctgggactacaggtgcccgtcactacgcccagctaatttttgtatttttggtagagatggggtttcaccatgttagccaggctggtctcgaactcctgacctcatgtgatccacccgcttcagcctcccaaagtgctgggattacaggcatgagccactgcgcctggctccactttatttttaaatcagtgtttttcaaagcaaggacgccctcttctaaattccagtctgaggtggaatcccacaaaacagcatgagccgtatttattagagcacaggtgcggatgtcgtatgtggccactgatgctgggaccatgaactggggttgaatagggctctttaccacccaactgtgaccttgggaaagtcacctaaacccccctggcctcaatattcctcatctgtacattcgcatcatgagaaataaattaccaccagcaaagcgctcagaaacagtgcctggcctccagggctggcttcatgggcgtgtgacctatgtggttatgtggcaccctgtgctttgtttaatgctctgtggtcgccatcttgaaatctgaacaaggggccctgcaggttacatagctggtcctgctggcacacagcctgcatctggcaagtctggctatttgcatttgctttaacaactcaggatcacagtgtttggggatcttagagtcagagggttttttttttttttttttcttgagacggagtcttgatctgtcgcctaggctggagtgcagtggtatgatctcagctcactgcaaactccgcctcccaggttcaagcaattctctgcctcagcctcccaagtagttgggactacagacacctgccaccacgcctggctaattttttgtacttttagtagacacagggtttcaccatcttggcgaggctggtcttgaactcctgacctcgtgatccacccgcctcggcctcccaaagtgctgggattacaggcgtgagccaccacgcccagccggggtcagagggtttgtaagtagaaggggacagatttccaggtctgggcatgtttggagctggggacaggggcccctagctctcaggacctgaatgtgaggttaggttccctgcaccgtgcagacctcctccctgccccccagcagtctgagtctgccaccaccagtcctggggtcgctcaccacagatgaagccttggtcagtgccattttcccagccaggtgggcctgcatggcactcagcttctccttctccagcaccagctgtgaaatggcacaaacatgaggcctcagcctggcccttctctgccacatctttgcccaggctacggtcttccctgggagtgcccgctcctcttccttcctttataccagccctcgtcccaggtgaacttggtttctggcacatggtggacagaaggttttgcgcactatccctatcccttaccctccaccgccctggcattacctgctgctccagagactgtaccatctctctctggaggagacattgtgccctgcccttctcatccagaagatggtccgcctggcagtgcctaagtagggagaagattccatgcaggtgaccacgacaggcctggtctggctcaatgctctgaatggggagggcccagaccctctgggagttctctcctctgagccccagctcccctcccctctctacctcagtctccctctcacacccctcgttcccttaacacatgcccctcagcacctactgcatgtcaggcctgaactcaccacttgagcctggccagagtgctggagataatgttggaagtgtggtgagttgagaatgggccagggaggtgagagtgggcaaagcattctgggtggagggacggcctgtgcaaaggcctggctgcaaggaggacaggacatgtggggttgctgctaagggttgtgtgtagtgtggtgtgtatttgtgtgtgtgtgtgtgtgagagagagagaaagagagagagagagagagagagagagagacatatggggggactgaggggaggcagcagcagccatctagaggagctagaactttgggaacagtggaataaggctggcatgttggcatgaggagtagcagggcaaagcaggagtgcagattctagagcctggctacatgggttcaaatcccagctctgtcactcaggaactgggagattttgatcaagacacttaacctctttggcctcagtctccttgtctgtaaaatgggggtaaataacagcacaaacgtttcttattatacatacgagaaaactgaggtcgagagaagctaagtaatttgtccaaggtcacacagccagtcagggatggagctgggatttgaacccacagtctcagagtttagctcttgcatcttactacttattgggatgaagcctgagctgagatctgcaccctagacctctccccacaagccagggccggtagactggcacaggcctgggccactcacttgaggaagtcctctggctcttcgaagaccttctcacatccgggccacttgcagacaccatttgccagcagtgggtaggagctctggggcacagccgaaagggtgctggggggacagagggtgtcaggggaggggataggagggcgaggatccttcccagccctgtccactgacctgtccttcctgggtgcactgggatttgggaaggtgc
